(12) United States Patent
Rabuka et al.

(10) Patent No.: US 12,385,025 B2
(45) Date of Patent: *Aug. 12, 2025

(54) COMPOSITIONS AND METHODS FOR NUCLEIC ACID MODIFICATIONS

(71) Applicant: ACRIGEN BIOSCIENCES, Berkeley, CA (US)

(72) Inventors: David Rabuka, Berkeley, CA (US); Allison Sharrar, Berkeley, CA (US); Michael Schelle, Berkeley, CA (US); Luisa Mayumi Arake de Tacca, Berkeley, CA (US)

(73) Assignee: ACRIGEN BIOSCIENCES, Berkeley, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 19/056,056

(22) Filed: Feb. 18, 2025

(65) Prior Publication Data

US 2025/0179456 A1 Jun. 5, 2025

Related U.S. Application Data

(63) Continuation of application No. 18/696,667, filed as application No. PCT/US2022/077169 on Sep. 28, 2022.

(60) Provisional application No. 63/249,296, filed on Sep. 28, 2021.

(51) Int. Cl.
| | |
|---|---|
| *C12N 9/22* | (2006.01) |
| *C12N 5/0783* | (2010.01) |
| *C12N 15/11* | (2006.01) |
| *C12N 15/82* | (2006.01) |
| *C12N 15/86* | (2006.01) |

(52) U.S. Cl.
CPC ............ *C12N 9/22* (2013.01); *C12N 5/0636* (2013.01); *C12N 15/111* (2013.01); *C12N 15/8261* (2013.01); *C12N 15/86* (2013.01); *C07K 2319/09* (2013.01); *C12N 2310/20* (2017.05); *C12N 2510/00* (2013.01)

(58) Field of Classification Search
CPC ...... C12N 9/22; C12N 5/0636; C12N 15/111; C12N 15/8261; C12N 15/86; C12N 2310/20; C12N 2510/00; C07K 2319/09
See application file for complete search history.

(56) References Cited

U.S. PATENT DOCUMENTS

| | | | |
|---|---|---|---|
| 5,034,506 A | 7/1991 | Summerton et al. | |
| 5,736,396 A | 4/1998 | Bruder et al. | |
| 8,546,553 B2 | 10/2013 | Terns et al. | |
| 8,697,359 B1 | 4/2014 | Zhang | |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 8,889,356 B2 | 11/2014 | Zhang | |
| 8,889,418 B2 | 11/2014 | Zhang et al. | |
| 8,895,308 B1 | 11/2014 | Zhang et al. | |
| 8,906,616 B2 | 12/2014 | Zhang et al. | |
| 8,932,814 B2 | 1/2015 | Cong et al. | |
| 8,945,839 B2 | 2/2015 | Zhang | |
| 8,993,233 B2 | 3/2015 | Zhang et al. | |
| 8,999,641 B2 | 4/2015 | Zhang et al. | |
| 9,115,348 B2 | 8/2015 | Haurwitz et al. | |
| 9,149,049 B2 | 10/2015 | Manoury et al. | |
| 9,404,098 B2 | 8/2016 | Terns et al. | |
| 9,493,844 B2 | 11/2016 | Sastry-Dent et al. | |
| 9,567,603 B2 | 2/2017 | Joung et al. | |
| 9,637,739 B2 | 5/2017 | Siksnys et al. | |
| 9,663,782 B2 | 5/2017 | Yu et al. | |
| 9,885,026 B2 | 2/2018 | Brouns et al. | |
| 9,951,342 B2 | 4/2018 | Barrangou et al. | |
| 10,087,431 B2 | 10/2018 | Wiedenheft et al. | |
| 10,227,610 B2 | 3/2019 | Chen et al. | |
| 10,266,850 B2 | 4/2019 | Doudna et al. | |
| 10,601,748 B2 | 3/2020 | Lan et al. | |
| 10,604,771 B2 | 3/2020 | Cannon et al. | |
| 10,760,064 B2 | 9/2020 | Joung et al. | |
| 2010/0076057 A1 | 3/2010 | Sontheimer et al. | |
| 2011/0293703 A1 | 12/2011 | Mahon et al. | |
| 2013/0244279 A1 | 9/2013 | De Fougerolles et al. | |
| 2013/0245107 A1 | 9/2013 | De Fougerolles et al. | |

(Continued)

FOREIGN PATENT DOCUMENTS

| | | |
|---|---|---|
| WO | WO-2014118272 A1 | 8/2014 |
| WO | WO-2018073393 A2 | 4/2018 |

(Continued)

OTHER PUBLICATIONS

Harrington Sequence Alignment (a sequence alignment of SEQ ID No. 534 of Harrington aligned with instantly recited SEQ ID No. 545, aligned Mar. 20, 2025, SEQ ID No. 534 published Aug. 15, 2024 with effective filing date of Aug. 27, 2021 (Year: 2021).

(Continued)

*Primary Examiner* — Anne M. Gussow
*Assistant Examiner* — Kyle T Rega
(74) *Attorney, Agent, or Firm* — WILSON SONSINI GOODRICH & ROSATI

(57) ABSTRACT

The present disclosure provides nucleases and compositions, methods, and systems thereof for nucleic acid modification. More particularly, the present disclosure provides compositions and system comprising a nuclease comprising an amino acid sequence having at least 70% identity to any of SEQ ID NOs: 1-1096 and at least one gRNA.

16 Claims, 8 Drawing Sheets

Specification includes a Sequence Listing.

(56) References Cited

U.S. PATENT DOCUMENTS

| | | |
|---|---|---|
| 2013/0252281 A1 | 9/2013 | De Fougerolles et al. |
| 2013/0302401 A1 | 11/2013 | Ma et al. |
| 2014/0113376 A1 | 4/2014 | Sorek et al. |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0189896 A1 | 7/2014 | Zhang et al. |
| 2014/0199767 A1 | 7/2014 | Barrangou et al. |
| 2014/0201857 A1 | 7/2014 | Fahrenkrug et al. |
| 2014/0212869 A1 | 7/2014 | Sampas et al. |
| 2014/0242664 A1 | 8/2014 | Zhang et al. |
| 2014/0242699 A1 | 8/2014 | Zhang |
| 2014/0273230 A1 | 9/2014 | Chen et al. |
| 2014/0287938 A1 | 9/2014 | Zhang et al. |
| 2014/0294773 A1 | 10/2014 | Brouns et al. |
| 2014/0309487 A1 | 10/2014 | Lee et al. |
| 2014/0310828 A1 | 10/2014 | Lee et al. |
| 2014/0310830 A1 | 10/2014 | Zhang et al. |
| 2014/0315985 A1 | 10/2014 | May et al. |
| 2014/0349400 A1 | 11/2014 | Jakimo et al. |
| 2014/0357530 A1 | 12/2014 | Zhang et al. |
| 2015/0031134 A1 | 1/2015 | Zhang et al. |
| 2015/0050699 A1 | 2/2015 | Siksnys et al. |
| 2021/0017249 A1 | 1/2021 | Sather et al. |
| 2021/0024958 A1 | 1/2021 | Miller et al. |
| 2024/0271113 A1 | 8/2024 | Harrington et al. |
| 2025/0179455 A1 | 6/2025 | Rabuka et al. |

FOREIGN PATENT DOCUMENTS

| | | | | |
|---|---|---|---|---|
| WO | WO-2020142754 A2 | 7/2020 | | |
| WO | WO-2021092130 A1 | 5/2021 | | |
| WO | WO-2021178933 A2 | 9/2021 | | |
| WO | WO-2021178934 A1 | 9/2021 | | |
| WO | WO-2023028444 A1 * | 3/2023 | ............. | A61K 38/00 |
| WO | WO-2023056291 A1 | 4/2023 | | |
| WO | WO-2024020346 A2 | 1/2024 | | |

OTHER PUBLICATIONS

Peng, X. GenBank Accession No. MBE6326412. Version No. MBE6326412.1. Mag: type V CRISPR-associated protein Cpf1 [Bacteroidales bacterium]: pp. 1-3. Record created Oct. 28, 2020. Retrieved Mar. 18, 2025. Retrieved from: https://www.ncbi.nlm.nih.gov/protein/MBE6326412.1/.

Safari, Fatemeh. et al. CRISPR Cpf1 proteins: structure, function and implications for genome editing. Cell and Bioscience 9:36, 1-21 (2019).

U.S. Appl. No. 19/056,045 Office Action dated Mar. 25, 2025.

Altschul, Stephen F. et al. Basic Local Alignment Search Tool. Journal of Molecular Biology 215(3):403-410 (1990).

Altschul, Stephen F. et al. Gapped BLAST and PSI-BLAST: a new Generation of Protein Database Search Programs. Nucleic Acids Research 25(17):3389-3402 (1997).

Ausubel, Frederick M. et al. Current Protocols in Molecular Biology. John Wiley & Sons (1989).

Basha, Genc. et al. Influence of cationic lipid composition on gene silencing properties of lipid nanoparticle formulations of siRNA in antigen-presenting cells. Molecular Therapy 19(12):2186-2200 (2011).

Biegert, Andreas, and Johannes Söding. Sequence context-specific profiles for homology searching. Proceedings of the National Academy of Sciences 106(10):3770-3775 (2009).

Bloem, L. J. et al. GenBank Accession No. S62283. Version No. S62283.1. 5-HT1C serotonin receptor {promoter region} [mice, Genomic, 1859 nt]: pp. 1-2. Record Created Aug. 25, 1993. Retrieved Dec. 13, 2024. Retrieved from: https://www.ncbi.nlm.nih.gov/nuccore/S62283.

Braasch, Dwaine A, and David R. Corey. Novel antisense and peptide nucleic acid strategies for controlling gene expression. Biochemistry 41(14):4503-4510 (2002).

Brinkman, Eva K. et al. Easy quantitative assessment of genome editing by sequence trace decomposition. Nucleic acids research 42(22):e168, 1-8 (2014).

Chen, Kunling. et al. CRISPR/Cas genome editing and precision plant breeding in agriculture. Annual review of plant biology 70(1):667-697 (2019).

Chial, Heidi. Rare genetic disorders: learning about genetic disease through gene mapping, SNPs, and microarray data. Nature education 1(1):192 (2008).

Clement, Kendell. et al. CRISPResso2 Provides Accurate and Rapid Genome Editing Sequence Analysis. Nature Biotechnology 37(3):224-226 (2019).

Doudna, Jennifer A, and Emmanuelle Charpentier. Genome editing. The new frontier of genome engineering with CRISPR-Cas9. Science 346(6213):1258096, 1-11 (2014).

Glick, Bernard R, and John E, Thompson. Methods in Plant Molecular Biology and Biotechnology. CRC Press :1-177 (1993).

Gusfield, Dan. Algorithms on strings, trees and sequences: computer science and computational biology. Cambridge University Press (1997).

Heigwer, Florian. Et al. E-CRISP: fast CRISPR target site identification. Nature methods 11(2):122-123 (2014).

Jinek, Martin. et al. A Programmable Dual-RNA-guided DNA Endonuclease in Adaptive Bacterial Immunity. Science 337(6096):816-821 (2012).

Kaufman, Randal J. et al. Translational efficiency of polycistronic mRNAs and their utilization to express heterologous genes in mammalian cells. The EMBO Journal 6(1):187-193 (1987).

Kay, Mark A. et al. Viral vectors for gene therapy: the art of turning infectious agents into vehicles of therapeutics. Nature medicine 7(1):33-40 (2001).

Klein, Theodore M. et al. High-velocity microprojectiles for delivering nucleic acids into living cells. Nature 327(6117):70-73 (1987).

Li, Xiaosa. et al. Base editing with a Cpf1-cytidine deaminase fusion. Nature biotechnology 36(4):324-327 (2018).

Nair, Jayaprakash K. et al. Multivalent N-acetylgalactosamine-conjugated siRNA localizes in hepatocytes and elicits robust RNAi-mediated gene silencing. Journal of the American Chemical Society 136(49):16958-16961 (2014).

Noguchi, Hirofumi. et al. PDX-1 protein containing its own antennapedia-like protein transduction domain can transduce pancreatic duct and islet cells. Diabetes 52(7):1732-1737 (2003).

Oliva, D. et al. GenBank Accession No. X51956. Version No. X51956.1. Human ENO2 gene for neuron specific (gamma) enolase : pp. 1-5. Record created Apr. 21, 1993. Retrieved Dec. 13, 2024. Retrieved from: https://www.ncbi.nlm.nih.gov/nuccore/X51956.

PCT/US2022/077169 International Search Report and Written Opinion dated Jan. 20, 2023.

PCT/US2023/070339 International Search Report and Written Opinion dated Jan. 23, 2024.

PCT/US2023/070339 Invitation to Pay Additional Fees dated Nov. 24, 2023.

Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.

Ran, Ann F. et al. Genome engineering using the CRISPR-Cas9 system. Nature Protocols 8(11):2281-2308 (2013). Published online Oct. 24, 2013.

Rogaev, E. et al. GenBank Accession No. L04147. Version No. L04147.1. Human neurofilament light chain (NEFL) gene, promoter region: pp. 1-2. Record Created Apr. 27, 1993. Retrieved Dec. 13, 2024. Retrieved from: https://www.ncbi.nlm.nih.gov/nuccore/L04147.

Sauerwald, A. et al. GenBank Accession No. M55301. Version No. M55301.1. Human synapsin I gene, 5' end: pp. 1-2. Record Created Aug. 3, 1993. Retrieved Dec. 13, 2024. Retrieved from: https://www.ncbi.nlm.nih.gov/nuccore/M55301.

Schulz, G. E, and R.H. Schirmer. Principles of Protein Structure. Springer-Verlag :1-7 (1979).

Seed, Brian. An LFA-3 cDNA encodes a phospholipid-linked membrane protein homologous to its receptor CD2. Nature 329(6142):840-842 (1987).

(56) References Cited

OTHER PUBLICATIONS

Soding, Johannes. Protein homology detection by HMM-HMM comparison. Bioinformatics 21(7):951-960 (2005). Published online Nov. 5, 2004.
Trehin, Rachel. et al. Cellular Uptake but Low Permeation of Human Calcitonin-Derived Cell Penetrating Peptides and Tat (47-57) Through Well-Differentiated Epithelial Models. Pharmaceutical Research 21(7):1248-1256 (2004).
U.S. Appl. No. 63/368,722, inventor Ladha; Alim, filed on Jul. 18, 2022.
U.S. Appl. No. 63/368,724, inventor Ladha; Alim, filed on Jul. 18, 2022.
U.S. Appl. No. 63/368,726, inventor Ladha; Alim, filed on Jul. 18, 2022.
U.S. Appl. No. 63/368,728, inventor Ladha; Alim, filed on Jul. 18, 2022.
U.S. Appl. No. 63/368,730, inventor Ladha; Alim, filed on Jul. 18, 2022.
U.S. Appl. No. 63/368,731, inventor Ladha; Alim, filed on Jul. 18, 2022.
U.S. Appl. No. 63/368,734, inventor Ladha; Alim, filed on Jul. 18, 2022.
U.S. Appl. No. 63/368,735, inventor Ladha; Alim, filed on Jul. 18, 2022.
U.S. Appl. No. 63/368,736, inventor Ladha; Alim, filed on Jul. 18, 2022.
U.S. Appl. No. 63/368,737, inventor Ladha; Alim, filed on Jul. 18, 2022.
U.S. Appl. No. 63/368,738, inventor Ladha; Alim, filed on Jul. 18, 2022.
U.S. Appl. No. 63/368,741, inventor Ladha; Alim, filed on Jul. 18, 2022.
U.S. Appl. No. 63/368,742, inventor Ladha; Alim, filed on Jul. 18, 2022.
U.S. Appl. No. 63/368,744, inventor Ladha; Alim, filed on Jul. 18, 2022.
U.S. Appl. No. 63/495,198, inventor Giedrius; Gasiunas, filed on Apr. 10, 2023.
Wahlestedt, Claes. et al. Potent and Nontoxic Antisense Oligonucleotides Containing Locked Nucleic Acids. PNAS USA 97(10):5633-5638 (2000).
Walther, W., et al., (2000), Viral Vectors for Gene Transfer, Drugs 60: 249-71.
Walton, Russell T. et al. Unconstrained Genome Targeting with near-PAMless Engineered CRISPR-Cas9 Variants. Science 368(6488):290-296 (2020).
Wang, Jing. et al. Cyclohexene nucleic acids (CeNA): serum stable oligonucleotides that activate RNase H and increase duplex stability with complementary RNA. Journal of the American Chemical Society 122(36):8595-8602 (2000).
Wender, Paul A. et al. The design, synthesis, and evaluation of molecules that enable or enhance cellular uptake: Peptoid molecular transporters. Proceedings of the National Academy of Sciences of the United States of America 97(24):13003-13008 (2000).
Xiao, et al. A novel significance score for gene selection and ranking. Bioinformatics 30(6):801-807 (2014).
Zender, Lars. et al. VP22-mediated intercellular transport of p53 in hepatoma cells in vitro and in vivo. Cancer gene therapy 9(6):489-496 (2002).
Zhu, Lihua Julie. Overview of guide RNA design tools for CRISPR-Cas9 genome editing technology. Frontiers in Biology 10(4):289-296 (2015).
Zhu, Pengli. et al. The relationship of retinal vessel diameters and fractal dimensions with blood pressure and cardiovascular risk factors. PloS one 9(9):e106551, 1-10 (2014).
Liu, Pengpeng et al. Enhanced Cas12a editing in mammalian cells and zebrafish. Nucleic Acids Research 47(8):4169-4180 (2019).
U.S. Appl. No. 19/056,045 Office Action dated May 21, 2025.
Xie, F. et al. GenBank Accession No. MBR6223972. Version No. MBR6223972. 1MAG: type V CRISPR-associated protein Cas12a/Cpf1 [Lachnospiraceae bacterium]. pp. 1-3. Record created Apr. 22, 2021. Retrieved May 28, 2025. Retrieved from: https://www.ncbi.nlm.nih.gov/protein/MBR6223972.

\* cited by examiner

COMPOSITIONS AND METHODS FOR NUCLEIC ACID MODIFICATIONS

CROSS-REFERENCE TO RELATED APPLICATIONS

This application is a continuation of U.S. application Ser. No. 18/696,667, filed Mar. 28, 2024, which is a National Stage of International Application No. PCT/US2022/077169, filed Sep. 28, 2022, which claims the benefit of U.S. Provisional Application No. 63/249,296, filed Sep. 28, 2021, the content of which are herein incorporated by reference in their entirety.

FIELD

The present invention relates to nucleases and compositions, methods, and systems thereof for nucleic acid modification.

SEQUENCE LISTING STATEMENT

The contents of the electronic sequence listing titled ACRIG-39930-601.xml (Size: 2,456,778 bytes; and Date of Creation: Sep. 28, 2022) is herein incorporated by reference in its entirety.

BACKGROUND

Clustered regularly interspaced short palindromic repeats (CRISPR)-associated (Cas) nucleases dominate the nucleic acid-editing landscape because they are versatile, rapid, and easy-to-use editing tools. The most well-characterized CRISPR-Cas nuclease, Cas9, utilizes one or more RNAs to act as a sequence-specific targeting element linking the nuclease to the target nucleic acid. However, presently CRISPR/Cas systems have some limitations for use in eukaryotic organisms including: inefficient delivery to mature cells in large numbers, low efficiency of editing, off-target events, target sequence preferences, and optimal temperatures and conditions for enzymatic activity.

SUMMARY

Provided herein are engineered nucleases comprising an amino acid sequence of at least 70% identity, at least 80% identity, at least 85% identity, at least 90% identity, or at least 95% identity to an amino acid sequence of SEQ ID NOs: 1-5, 8-465, 1063-1070, 1080-1081 and 1095. Provided herein are engineered nucleases having the amino acid sequence of 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity to an amino acid sequence of SEQ ID NOs: 1-5, 8-465, 1063-1070, 1080-1081 and 1095. In some embodiments, the engineered nuclease comprises an amino acid sequence having at least 90% identity (e.g., at least 90%, at least 91%, at least 92%, at least 93%, at least 94%, at least 95%, at least 96%, at least 97%, at least 98%, at least 99%) to an amino acid sequence of SEQ ID NOs: 1-5, 8-465, 1063-1070, 1080-1081 and 1095. In select embodiments, the engineered nuclease comprises an amino acid sequence selected from the group consisting of SEQ ID NOs: 1-1096.

Provided herein are engineered nucleases comprising an amino acid sequence having at least 90% or at least 95% identity to SEQ ID NO: 328 and one, two, three, four, five, or six substitutions at positions selected from the group consisting of: 164, 271, 559, 564, 570, and 827. In some embodiments, the engineered nuclease comprises substitutions at positions selected from the group consisting of: 164, 559, 564, 570, 827, 164/564, 164/570, 564/570, 164/564/570, 164/570/271, and 559/827. In some embodiments, the engineered nuclease comprises, two, three, four, five, or six substitutions selected from the group consisting of: K164R, N271A, N559R, N564R, N570R, and Q827L. In some embodiments, the engineered nuclease comprises substitutions selected from the group consisting of: K164R, N564R, N570R, K164R/N564R, K164R/N570R, N564R/N570R, K164R/N564R/N570R, K164R/N570R/N271A, N559R, Q827L, and N559R/Q827L.

Provided herein are engineered nucleases comprising an amino acid sequence having at least 90% or at least 95% identity to SEQ ID NO: 333 and one, two, three, four, five, or six substitutions at positions selected from the group consisting of: 165, 271, 560, 565, 572, and 829. In some embodiments, the engineered nuclease comprises substitutions at positions selected from the group consisting of: 165, 560, 565, 572, 829, 165/565, 165/572, 165/565/572, 165/572/271, and 560/829. In some embodiments, the engineered nuclease comprises one, two, three, four, five, or six substitutions selected from the group consisting of: E165R, N271A, N560R, K565R, K572R, and Q829L. In some embodiments, the engineered nuclease comprises substitutions selected from the group consisting of: E165R, N560R, K565R, K572R, Q829L, E165R/K565R, E165R/K572R, E165R/K565R/K572R, E165R/K572R/N271A, and N560R/Q829L.

Provided herein are engineered nucleases comprising an amino acid sequence having at least 90% or at least 95% identity to SEQ ID NO: 325 with, two, three, four, five, or six substitutions at positions selected from the group consisting of: 163, 269, 590, 595, 600, and 860. In some embodiments, the engineered nuclease comprises substitutions at positions selected from the group consisting of: 165, 590, 595, 600, 860, 163/595, 163/600, 595/600, 163/595/600, 163/595/269, and 590/860. In some embodiments, the engineered nuclease comprises one, two, three, four, five, or six substitutions selected from the group consisting of: E163R, N269A, N590R, D595R, K600R, and Q860L. In some embodiments, the engineered nuclease comprises substitutions selected from the group consisting of: E163R, N590R, D595R, K600R, Q860L, E163R/D595R, E163R/K600R, D595R/K600R, E163R/D595R/K600R, E163R/D595R/N269A, and N590R/Q860L.

Provided herein are engineered nucleases comprising an amino acid sequence having at least 90% or at least 95% identity to SEQ ID NO: 339 with one, two, three, four, five, or six substitutions at positions selected from the group consisting of: 163, 260, 532, 537, 544, and 801. In some embodiments, the engineered nuclease comprises substitutions at positions selected from the group consisting of: 163, 260, 532, 537, 544, 801, 163/537, 163/644, 537/544, 163/537/544, 163/544/260, and 532/801. In some embodiments, the engineered nuclease comprises one, two, three, four, five, or six substitutions selected from the group consisting of: Q163R, N260A, S532R, D537R, K544R, and Q801L. In some embodiments, the engineered nuclease comprises substitutions selected from the group consisting of: Q163R, N260A, S532R, D537R, K544R, Q801L, Q163R/D537R, Q163R/K544R, D537R/K544R, Q163R/D537R/D544R, Q163R/D544R/N260A, and S532R/Q801L.

Provided herein are engineered nucleases comprising an amino acid sequence having at least 90% or at least 95% identity to SEQ ID NO: 336 and one, two, three, four, five, or six substitutions at positions selected from the group consisting of: 153, 259, 546, 551, 557, and 815. In some embodiments, the engineered nuclease comprises substitutions at positions selected from the group consisting of: 153, 259, 546, 551, 557, 815, 153/551, 153/557, 551/557, 153/551/557, 153/557/259, and 546/815. In some embodiments, the engineered nuclease comprises one, two, three, four, five, or six substitutions selected from the group consisting of: K153R, N259A, N546R, G551R, K557R, and Q815L. In some embodiments, the engineered nuclease comprises substitutions selected from the group consisting of: K153R, N259A, N546R, G551R, K557R, Q815L, K153R/G551R, K153R/K557R, G551R/K557R, K153R/G551R/K557R, K153R/K557R/N259A, and N546R/Q815L.

Provided herein are engineered nucleases comprising an amino acid sequence having at least 90% or at least 95% identity to SEQ ID NO: 348 with one, two, three, four, five, or six substitutions at positions selected from the group consisting of: 160, 267, 554, 559, 565, and 832. In some embodiments, the engineered nuclease comprises substitutions at positions selected from the group consisting of: 160, 267, 554, 559, 565, 832, 160/559, 160/565, 559/565, 160/559/565, 160/565/267, and 554/832. In some embodiments, the engineered nuclease comprises one, two, three, four, five, or six substitutions selected from the group consisting of: E160R, N267A, N554R, N559R, K565R, and Q832L. In some embodiments, the engineered nuclease comprises substitutions selected from the group consisting of: E160R, N267A, N554R, N559R, K565R, Q832L, E160R/N559R, E160R/K565R, N559R/K565R, E160R/N559R/K565R, E160R/K565R/N267A, and N554R/Q832L.

Provided herein are engineered nucleases comprising an amino acid sequence having at least 90% or at least 95% identity to SEQ ID NO: 341 and one, two, three, four, five, or six substitutions at positions selected from the group consisting of: 156, 262, 536, 541, 547, and 805. In some embodiments, the engineered nuclease comprises substitutions at positions selected from the group consisting of: 156, 262, 536, 541, 547, 805, 156/541, 156/547, 541/547, 156/541/547, 156/547/262, and 536/805. In some embodiments, the engineered nuclease comprises one, two, three, four, five, or six substitutions selected from the group consisting of: E156R, N262A, K536R, N541R, K547R, and Q805L. In some embodiments, the engineered nuclease comprises substitutions selected from the group consisting of: E156R, N262A, K536R, N541R, K547R, Q805L, E156R/N541R, E156R/K547R, N541R/K547R, E156R/N541R/K547R, E156R/K547R/N262A, and K536R/Q805L.

Provided herein are engineered nucleases comprising an amino acid sequence having at least 90% or at least 95% identity to SEQ ID NO: 346 with one, two, three, four, five, or six substitutions at positions selected from the group consisting of: 166, 271, 548, 553, 559, and 817. In some embodiments, the engineered nuclease comprises substitutions at positions selected from the group consisting of: 166, 271, 548, 553, 559, 817, 166/553, 166/559, 553/559, 166/553/559, 166/559/271, and 548/817. In some embodiments, the engineered nuclease comprises one, two, three, four, five, or six substitutions selected from the group consisting of: E166R, N271A, N548R, G553R, K559R, and Q817L. In some embodiments, the engineered nuclease comprises substitutions selected from the group consisting of: E166R, N271A, N548R, G553R, K559R, Q817L, E166R/G553R, E166R/K559R, G553R/K559R, E166R/G553R/K559R, E166R/K559R/N271A, and N548R/Q817L.

Provided herein are engineered nucleases comprising an amino acid sequence having at least 90% or at least 95% identity to SEQ ID NO: 347 and one, two, three, four, five, or six substitutions at positions selected from the group consisting of: 166, 273, 563, 568, 574, and 866. In some embodiments, the engineered nuclease comprises substitutions at positions selected from the group consisting of: 166, 273, 563, 568, 574, 866, 166/568, 166/574, 568/574, 166/568/574, 166/574/273, and 536/866. In some embodiments, the engineered nuclease comprises one, two, three, four, five, or six substitutions selected from the group consisting of: E166R, N273A, N563R, K568R, K574R, and Q866L. In some embodiments, the engineered nuclease comprises substitutions selected from the group consisting of: E166R, N273A, N563R, K568R, K574R, Q866L, E166R/K568R, E166R/K574R, K568R/K574R, E166R/K568R/K574R, E166R/K574R/N273A, and N563R/Q866L.

Provided herein are engineered nucleases comprising an amino acid sequence having at least 90% or at least 95% identity to SEQ ID NO: 351 and one, two, three, four, or five substitutions at positions selected from the group consisting of: 157, 263, 547, 553, and 811. In some embodiments, the engineered nuclease comprises substitutions at positions selected from the group consisting of: 157, 263, 547, 553, 811, 157/547, 157/553, 547/553, 157/547/553, and 157/553/263. In some embodiments, the engineered nuclease comprises one, two, three, four, or five substitutions selected from the group consisting of: E157R, N263A, A547R, K553R, and Q811L. In some embodiments, the engineered nuclease comprises substitutions selected from the group consisting of: E157R, N263A, A547R, K553R, Q811L, E157R/A547R, E157R/K553R, A547R/K553R, E157R/A547R/K553R, and E157R/K553R/N263A.

Provided herein are engineered nucleases comprising an amino acid sequence having at least 90% or at least 95% identity to SEQ ID NO: 364 and one, two, three, four, five, or six substitutions at positions selected from the group consisting of: 153, 252, 508, 513, 519, and 771. In some embodiments, the engineered nuclease comprises substitutions at positions selected from the group consisting of: 153, 252, 508, 513, 519, 771, 153/513, 153/519, 513/519, 153/513/519, 153/519/252, and 508/771. In some embodiments, the engineered nuclease comprises one, two, three, four, five, or six substitutions selected from the group consisting of: T153R, N252A, T508R, N513R, N519R, and Q771L. In some embodiments, the engineered nuclease comprises substitutions selected from the group consisting of: T153R, N252A, T508R, N513R, N519R, Q771L, T153R/N513R, T153R/N519R, T153R/N519R, T153R/N513R/N519R, T153R/N519R/N252A, and T508R/Q771L.

Provided herein are engineered nucleases comprising an amino acid sequence having at least 90% or at least 95% identity to SEQ ID NO: 373 with one, two, three, four, five, or six substitutions at positions selected from the group consisting of: 161, 267, 550, 555, 561, and 852. In some embodiments, the engineered nuclease comprises substitutions at positions selected from the group consisting of: 161, 267, 550, 555, 561, 852, 161/555, 161/561, 161/555/561, 161/561/267, and 550/852. In some embodiments, the engineered nuclease comprises one, two, three, four, five, or six substitutions selected from the group consisting of: E161R, N267A, N550R, D555R, K561R, and Q852L. In some embodiments, the engineered nuclease comprises substitutions selected from the group consisting of: E161R, N267A, N550R, D555R, K561R, Q852L, E161R/D555R, E161R/K561R, E161R/D555R/K561R, E161R/K561R/N267A, and N550R/Q852L.

Provided herein are engineered nucleases comprising an amino acid sequence having at least 90% or at least 95% identity to SEQ ID NO: 359 with one, two, three, four, five, or six substitutions at positions selected from the group consisting of: 157, 260, 527, 532, 538, and 797. In some embodiments, the engineered nuclease comprises substitutions at positions selected from the group consisting of: 157, 260, 527, 532, 538, 797, 157/532, 157/538, 157/532/527, 157/538/260, and 527/797. In some embodiments, the engineered nuclease comprises one, two, three, four, five, or six substitutions selected from the group consisting of: E157R, N260A, N527R, V532R, K538R, and S797L. In some embodiments, the engineered nuclease comprises substitutions selected from the group consisting of: E157R, N260A, N527R, V532R, K538R, S797L, E157R/V532R, E157R/K538R, E157R/V532R/N527R, E157R/K538R/N260A, and N527R/S797L.

Provided herein are engineered nucleases comprising an amino acid sequence having at least 90% or at least 95% identity to SEQ ID NO: 370 and one, two, three, four, or five substitutions at positions selected from the group consisting of: 187, 280, 559, 564, and 849. In some embodiments, the engineered nuclease comprises substitutions at positions selected from the group consisting of: 187, 280, 559, 564, 849, 187/564, 187/280, and 559/849. In some embodiments, the engineered nuclease comprises one, two, three, four, or five substitutions selected from the group consisting of: D187R, N280A, T559R, N564R, and Q849L. In some embodiments, the engineered nuclease comprises substitutions selected from the group consisting of: D187R, N280A, T559R, N564R, Q849L, D187R/N564R, D187R/N280A, and T559R/Q849L.

Provided herein are engineered nucleases comprising an amino acid sequence having at least 90% or at least 95% identity to SEQ ID NO: 374 and one, two, three, four, or five substitutions at positions selected from the group consisting of: 165, 271, 551, 556, and 562. In some embodiments, the engineered nuclease comprises substitutions at positions selected from the group consisting of: 165, 271, 551, 556, 562, 165/556, 165/562, 566/562, 165/556/562, and 165/562/271. In some embodiments, the engineered nuclease comprises one, two, three, four, or five substitutions selected from the group consisting of: E165R, N271A, N551R, D556R, and K562R. In some embodiments, the engineered nuclease comprises substitutions selected from the group consisting of: E165R, N271A, N551R, D556R, K562R, E165R/D556R, E165R/K562R, D556R/K562R, E165R/D556R/K562R, and E165R/K562R/N271A.

Provided herein are engineered nucleases comprising an amino acid sequence having at least 90% or at least 95% identity to SEQ ID NO: 375 with one, two, three, four, or five substitutions at positions selected from the group consisting of: 165, 271, 557, 562, and 850. In some embodiments, the engineered nuclease comprises substitutions at positions selected from the group consisting of: 165, 271, 557, 562, 850, 165/562, 165/271, and 557/850. In some embodiments, the engineered nuclease comprises one, two, three, four, or five substitutions selected from the group consisting of: Q165R, N271A, S557R, K562R, and Q850L. In some embodiments, the engineered nuclease comprises substitutions selected from the group consisting of: Q165R, N271A, S557R, K562R, Q850L, Q165R/K562R, Q165R/N271A, and S557R/Q850L.

Provided herein are engineered nucleases comprising an amino acid sequence having at least 90% or at least 95% identity to SEQ ID NO: 318 with one, two, three, four, five, or six substitutions at positions selected from the group consisting of: 166, 273, 562, 567, 573, and 830. In some embodiments, the engineered nuclease comprises substitutions at positions selected from the group consisting of: 166, 273, 562, 567, 573, 830, 166/567, 166/573, 567/573, 166/567/573, 166/573/273, and 562/830. In some embodiments, the engineered nuclease comprises one, two, three, four, five, or six substitutions selected from the group consisting of: E166R, N273A, N562R, D567R, K573R, and H830L. In some embodiments, the engineered nuclease comprises substitutions selected from the group consisting of: E166R, N273A, N562R, D567R, K573R, H830L, E166R/D567R, E166R/K573R, D567R/K573R, E166R/D567R/K573R, E166R/K573R/N273A, and N562R/H830L.

Provided herein are engineered nucleases comprising an amino acid sequence having at least 90% or at least 95% identity to SEQ ID NO: 28 and one, two, three, four, five, or six substitutions at positions selected from the group consisting of: 178, 283, 597, 602, 608, and 896. In some embodiments, the engineered nuclease comprises substitutions at positions selected from the group consisting of: 178, 283, 597, 602, 608, 896, 178/602, 178/608, 602/608, 178/602/608, 178/608/283, and 597/896. In some embodiments, the engineered nuclease comprises one, two, three, four, five, or six substitutions selected from the group consisting of: E178R, N283A, T597R, N602R, K608R, and Q896L. In some embodiments, the engineered nuclease comprises substitutions selected from the group consisting of: E178R, N283A, T597R, N602R, K608R, Q896L, E178R/N602R, E178R/K608R, N602R/K608R, E178R/N602R/K608R, E178R/K608R/N283A, and T597R/Q896L.

Provided herein are engineered nucleases comprising an amino acid sequence having at least 90% or at least 95% identity to SEQ ID NO: 409 with one, two, three, four, five, or six substitutions at positions selected from the group consisting of: 156, 261, 539, 544, 550, and 829. In some embodiments, the engineered nuclease comprises substitutions at positions selected from the group consisting of: 156, 261, 539, 544, 550, 829, 156/544, 156/550, 544/550, 156/544/550, 156/550/261, and 539/829. In some embodiments, the engineered nuclease comprises one, two, three, four, five, or six substitutions selected from the group consisting of: K156R, N261A, N539R, K544R, L550R, and S829L. In some embodiments, the engineered nuclease comprises substitutions selected from the group consisting of: K156R, N261A, N539R, K544R, L550R, S829L, K156R/K544R, K156R/L550R, K544R/L550R, K156R/K544R/L550R, K156R/L550R/N261A, and N539R/S829L.

Provided herein are engineered nucleases comprising an amino acid sequence having at least 90% or at least 95% identity to SEQ ID NO: 416 with one, two, three, four, five, or six substitutions at positions selected from the group consisting of: 178, 286, 541, 546, 552, and 873. In some embodiments, the engineered nuclease comprises substitutions at positions selected from the group consisting of: 178, 286, 541, 546, 552, 873, 178/546, 178/552, 546/552, 178/546/552, 178/552/286, and 541/873. In some embodiments, the engineered nuclease comprises one, two, three, four, five, or six substitutions selected from the group consisting of: E178R, N286A, N541R, D546R, K552R, and F873L. In some embodiments, the engineered nuclease comprises substitutions selected from the group consisting of: E178R, N286A, N541R, D546R, K552R, F873L, E178R/D546R, E178R/K552R, D546R/K552R, E178R/D546R/K552R, E178R/K552R/N286A, and N541R/F873L.

Provided herein are engineered nucleases comprising an amino acid sequence having at least 90% or at least 95% identity to SEQ ID NO: 420 and one, two, three, four, or five substitutions at positions selected from the group consisting of: 167, 279, 580, 585, and 591. In some embodiments, the engineered nuclease comprises substitutions at positions selected from the group consisting of: 167, 279, 580, 585, 591, 167/585, 167/591, 585/591, 167/585/591, and 167/591/279. In some embodiments, the engineered nuclease comprises one, two, three, four, or five substitutions selected from the group consisting of: E167R, N279A, S580R, N585R, and N591R. In some embodiments, the engineered nuclease comprises substitutions selected from the group consisting of: E167R, N279A, S580R, N585R, N591R, E167R/N585R, E167R/N591R, N585R/N591R, E167R/N585R/N591R, and E167R/N591R/N279A.

Provided herein are engineered nucleases comprising an amino acid sequence having at least 90% or at least 95% identity to SEQ ID NO: 394 and one, two, three, four, five, or six substitutions at positions selected from the group consisting of: 150, 245, 516, 521, 527, and 900. In some embodiments, the engineered nuclease comprises substitutions at positions selected from the group consisting of: 150, 245, 516, 521, 527, 900, 150/521, 150/527, 521/527, 150/521/527, 150/527/245, and 516/900. In some embodiments, the engineered nuclease comprises one, two, three, four, five, or six substitutions selected from the group consisting of: Q150R, N245A, C516R, N521R, K527R, and Q900L. In some embodiments, the engineered nuclease comprises substitutions selected from the group consisting of: Q150R, N245A, C516R, N521R, K527R, Q900L, Q150R/N521R, Q150R/K527R, N521R/K527R, Q150R/N521R/K527R, Q150R/K527R/N245A, and C516R/Q900L.

Provided herein are engineered nucleases comprising an amino acid sequence having at least 90% or at least 95% identity to SEQ ID NO: 396 with one, two, three, four, five, or six substitutions at positions selected from the group consisting of: 207, 300, 587, 592, 598, and 787. In some embodiments, the engineered nuclease comprises substitutions at positions selected from the group consisting of: 207, 300, 587, 592, 598, 787, 207/592, 207/598, 592/598, 207/592/598, 207/598/300, and 587/787. In some embodiments, the engineered nuclease comprises one, two, three, four, five, or six substitutions selected from the group consisting of: E207R, N300A, N587R, D592R, K598R, and F787L. In some embodiments, the engineered nuclease comprises selected from the group consisting of: E207R, N300A, N587R, D592R, K598R, F787L, E207R/D592R, E207R/K598R, D592R/K598R, E207R/D592R/K598R, E207R/K598R/N300A, and N587R/F787L.

Provided herein are engineered nucleases comprising an amino acid sequence having at least 90% or at least 95% identity to SEQ ID NO: 414 with one, two, three, four, or five substitutions at positions selected from the group consisting of: 168, 274, 553, 558, and 564. In some embodiments, the engineered nuclease comprises substitutions at positions selected from the group consisting of: 168, 274, 553, 558, 564, 168/558, 168/564, 558/564, 168/558/564, and 168/564/274. In some embodiments, the engineered nuclease comprises one, two, three, four, or five substitutions selected from the group consisting of: Q168R, N274A, C553R, N558R, and F564R. In some embodiments, the engineered nuclease comprises substitutions selected from the group consisting of: Q168R, N274A, C553R, N558R, F564R, Q168R/N558R, Q168R/F564R, N558R/F564R, Q168R/N558R/F564R, and Q168R/F564R/N274A.

Provided herein are engineered nucleases comprising an amino acid sequence having at least 90% or at least 95% identity to SEQ ID NO: 404 with one, two, three, four, five, or six substitutions at positions selected from the group consisting of: 192, 298, 583, 589, 595, and 899. In some embodiments, the engineered nuclease comprises substitutions at positions selected from the group consisting of: 192, 298, 583, 589, 595, 899, 192/589, 192/595, 589/595, 192/589/595, 192/595/298, and 583/899. In some embodiments, the engineered nuclease comprises one, two, three, four, five, or six substitutions selected from the group consisting of: E192R, N298A, N583R, N589R, K595R, and Q899L. In some embodiments, the engineered nuclease comprises substitutions selected from the group consisting of: E192R, N298A, N583R, N589R, K595R, Q899L, E192R/N589R, E192R/K595R, N589R/K595R, E192R/N589R/K595R, E192R/K595R/N298A, and N583R/Q899L.

Provided herein are engineered nucleases comprising an amino acid sequence having at least 90% or at least 95% identity to SEQ ID NO: 73 and one, two, three, four, or five substitutions at positions selected from the group consisting of: 202, 307, 603, 608, and 614. In some embodiments, the engineered nuclease comprises substitutions at positions selected from the group consisting of: 202, 307, 603, 608, 614, 202/608, 202/614, and 202/608/614. In some embodiments, the engineered nuclease comprises one, two, three, four, or five substitutions selected from the group consisting of: N202R, N307A, D603R, N608R, and D614R. In some embodiments, the engineered nuclease comprises substitutions selected from the group consisting of: N202R, N307A, D603R, N608R, D614R, N202R/N608R, N202R/D614R, N202R/N608R/D614R, and N202R/D614R/N307A.

Provided herein are engineered nucleases comprising an amino acid sequence having at least 90% or at least 95% identity to SEQ ID NO: 77 and one, two, three, four, five, or six substitutions at positions selected from the group consisting of: 175, 283, 572, 577, 583, and 917. In some embodiments, the engineered nuclease comprises substitutions at positions selected from the group consisting of: 175, 283, 572, 577, 583, 917, 175/577, 175/583, 577/583, 175/577/583, 175/583/283, and 572/917. In some embodiments, the engineered nuclease comprises one, two, three, four, five, or six substitutions selected from the group consisting of: D175R, N283A, K572R, K577R, K583R, and F917L. In some embodiments, the engineered nuclease comprises substitutions selected from the group consisting of: D175R, N283A, K572R, K577R, K583R, F917L, D175R/K577R, D175R/K583R, K577R/K583R, D175R/K577R/K583R, D175R/K583R/N283A, and K572R/F917L.

Provided herein are engineered nucleases comprising an amino acid sequence having at least 90% or at least 95% identity to SEQ ID NO: 74 and one, two, three, four, or five substitutions at positions selected from the group consisting of: 163, 268, 527, 533, and 539. In some embodiments, the engineered nuclease comprises substitutions at positions selected from the group consisting of: 163, 268, 527, 533, 539, 163/533, 163/539, 533/539, 163/533/539, and 163/539/268. In some embodiments, the engineered nuclease comprises one, two, three, four, or five substitutions selected from the group consisting of: E163R, N268A, N527R, N533R, and K539R. In some embodiments, the engineered nuclease comprises substitutions selected from the group consisting of: E163R, N268A, N527R, N533R, K539R, E163R/N533R, E163R/K539R, N533R/K539R, E163R/N533R/K539R, and E163R/K539R/N268A.

Provided herein are engineered nucleases comprising an amino acid sequence having at least 90% or at least 95% identity to SEQ ID NO: 432 and one, two, three, four, five, or six substitutions at positions selected from the group consisting of: 180, 273, 552, 557, 563, and 857. In some embodiments, the engineered nuclease comprises substitutions at positions selected from the group consisting of: 180, 273, 552, 557, 563, 857, 180/557, 180/563, 557/563, 180/

557/563, 180/563/273, and 552/857. In some embodiments, the engineered nuclease comprises one, two, three, four, five, or six substitutions selected from the group consisting of: E180R, N273A, S552R, N557R, K563R, and F857L. In some embodiments, the engineered nuclease comprises substitutions selected from the group consisting of: E180R, N273A, S552R, N557R, K563R, F857L, E180R/N557R, E180R/K563R, N557R/K563R, E180R/N557R/K563R, E180R/K563R/N273A, and S552R/F857L.

Provided herein are engineered nucleases comprising an amino acid sequence having at least 90% or at least 95% identity to SEQ ID NO: 437 and one, two, three, four, five, or six substitutions at positions selected from the group consisting of: 183, 281, 578, 583, 589, and 844. In some embodiments, the engineered nuclease comprises substitutions at positions selected from the group consisting of: 183, 281, 578, 583, 589, 844, 183/583, 183/589, 583/589, 183/583/589, 183/589/281, and 578/844. In some embodiments, the engineered nuclease comprises one, two, three, four, five, or six substitutions selected from the group consisting of: E183R, N281A, N578R, D583R, K589R, and F844L. In some embodiments, the engineered nuclease comprises substitutions selected from the group consisting of: E183R, N281A, N578R, D583R, K589R, F844L, E183R/D583R, E183R/K589R, D583R/K589R, E183R/D583R/K589R, E183R/K589R/N281A, and N578R/F844L.

Provided herein are engineered nucleases comprising an amino acid sequence having at least 90% or at least 95% identity to SEQ ID NO: 441 and one, two, three, four, five, or six substitutions at positions selected from the group consisting of: 165, 258, 497, 502, 508, and 794. In some embodiments, the engineered nuclease comprises substitutions at positions selected from the group consisting of: 165, 258, 497,502, 508, 794, 165/502, 165/508, 502/508, 165/502/508, 165/508/258, and 497/794. In some embodiments, the engineered nuclease comprises one, two, three, four, five, or six substitutions selected from the group consisting of: T165R, N258A, N497R, A502R, K508R, and E794L. In some embodiments, the engineered nuclease comprises substitutions selected from the group consisting of: T165R, N258A, N497R, A502R, K508R, E794L, T165R/A502R, T165R/K508R, A502R/K508R, T165R/A502R/K508R, T165R/K508R/N258A, and N497R/E794L.

Provided herein are engineered nucleases comprising an amino acid sequence having at least 90% or at least 95% identity to SEQ ID NO: 446 and one, two, three, four, or five substitutions at positions selected from the group consisting of: 195, 300, 647, 652, and 658. In some embodiments, the engineered nuclease comprises substitutions at positions selected from the group consisting of: 195, 300, 647, 652, 658, 195/652, 195/658, 652/658, 195/652/658, and 195/658/300. In some embodiments, the engineered nuclease comprises one, two, three, four, or five substitutions selected from the group consisting of: Q195R, N300A, Q647R, S652R, and K658R. In some embodiments, the engineered nuclease comprises substitutions selected from the group consisting of: Q195R, N300A, Q647R, S652R, K658R, Q195R/S652R, Q195R/K658R, S652R/K658R, Q195R/S652R/K658R, and Q195R/K658R/N300A.

Provided herein are engineered nucleases comprising an amino acid sequence having at least 90% or at least 95% identity to SEQ ID NO: 100 and one, two, three, four, five, or six substitutions at positions selected from the group consisting of: 185, 284, 585, 590, 596, and 825. In some embodiments, the engineered nuclease comprises substitutions at positions selected from the group consisting of: 185, 284, 585, 590, 596, 825, 185/590, 185/596, 590/596, 185/590/596, 185/596/284, and 585/825. In some embodiments, the engineered nuclease comprises one, two, three, four, five, or six substitutions selected from the group consisting of: N185R, N284A, H585R, G590R, K596R, and T825L. In some embodiments, the engineered nuclease comprises substitutions selected from the group consisting of: N185R, N284A, H585R, G590R, K596R, T825L, N185R/G590R, N185R/K596R, G590R/K596R, N185R/G590R/K596R, N185R/K596R/N284A, and H585R/T825L.

Provided herein are engineered nucleases comprising an amino acid sequence having at least 90% or at least 95% identity to SEQ ID NO: 104 with one, two, three, four, five, or six substitutions at positions selected from the group consisting of: 209, 316, 636, 641, 647, and 884. In some embodiments, the engineered nuclease comprises substitutions at positions selected from the group consisting of: 209, 316, 636, 641, 647, 884, 209/641, 209/647, 641/647, 209/641/647, 209/647/316, and 636/884. In some embodiments, the engineered nuclease comprises one, two, three, four, five, or six substitutions selected from the group consisting of: Q209R, N316A, N636R, G641R, Q647R, and F884L. In some embodiments, the engineered nuclease comprises substitutions selected from the group consisting of: Q209R, N316A, N636R, G641R, Q647R, F884L, Q209R/G641R, Q209R/Q647R, G641R/Q647R, Q209R/G641R/Q647R, Q209R/Q647R/N316A, and N636R/F884L.

Provided herein are engineered nucleases comprising an amino acid sequence having at least 90% or at least 95% identity to SEQ ID NO: 458 with one, two, three, four, five, or six substitutions at positions selected from the group consisting of: 180, 286, 589, 594, 600, and 853. In some embodiments, the engineered nuclease comprises substitutions at positions selected from the group consisting of: 180, 286, 589, 594, 600, 853, 180/594, 180/600, 594/600, 180/594/600, 180/600/286, and 589/853. In some embodiments, the engineered nuclease comprises one, two, three, four, five, or six substitutions selected from the group consisting of: T180R, N286A, N589R, G594R, E600R, and F853L. In some embodiments, the engineered nuclease comprises substitutions selected from the group consisting of: T180R, N286A, N589R, G594R, E600R, F853L, T180R/G594R, T180R/E600R, G594R/E600R, T180R/G594R/E600R, T180R/E600R/N286A, and N589R/F853L.

Provided herein are engineered nucleases comprising an amino acid sequence having at least 90% or at least 95% identity to SEQ ID NO: 461 and one, two, three, four, five, or six substitutions at positions selected from the group consisting of: 205, 309, 622, 627, 633, and 938. In some embodiments, the engineered nuclease comprises substitutions at positions selected from the group consisting of: 205, 309, 622, 627, 633, 938, 205/627, 205/633, 627/633, 205/627/633, 205/633/309, and 622/938. In some embodiments, the engineered nuclease comprises one, two, three, four, five, or six substitutions selected from the group consisting of: T205R, N309A, K622R, N627R, H633R, and I938L. In some embodiments, the engineered nuclease comprises substitutions selected from the group consisting of: T205R, N309A, K622R, N627R, H633R, I938L, T205R/N627R, T205R/H633R, N627R/H633R, T205R/N627R/H633R, T205R/H633R/N309A, and K622R/I938L.

Provided herein are engineered nucleases comprising an amino acid sequence having at least 90% or at least 95% identity to SEQ ID NO: 317 and one, two, three, four, five, or six substitutions at positions selected from the group consisting of: 157, 266, 551, 556, 562, and 820. In some embodiments, the engineered nuclease comprises substitutions at positions selected from the group consisting of: 157, 266, 551, 556, 562, 820, 157/556, 157/562, 556/562, 157/556/562, 157/562/266, and 551/820. In some embodiments, the engineered nuclease comprises one, two, three, four, five, or six substitutions selected from the group consisting of: E157R, N266A, N551R, D556R, K562R, and Q820L. In some embodiments, the engineered nuclease comprises substitutions selected from the group consisting of: E157R, N266A, N551R, D556R, K562R, Q820L, E157R/D556R, E157R/K562R, D556R/K562R, E157R/D556R/K562R, E157R/K562R/N266A, and N551R/Q820L.

Provided herein are engineered nucleases comprising an amino acid sequence having at least 90% or at least 95% identity to SEQ ID NO: 329 with one, two, three, four, five, or six substitutions at positions selected from the group consisting of: 164, 270, 549, 554, 560, and 819. In some embodiments, the engineered nuclease comprises substitutions at positions selected from the group consisting of: 164, 270, 549, 554, 560, 819, 164/554, 164/560, 554/560, 164/554/560, 164/560/270, and 549/819. In some embodiments, the engineered nuclease comprises one, two, three, four, five, or six substitutions selected from the group consisting of: E164R, N270A, N549R, K554R, K560R, and Q819L. In some embodiments, the engineered nuclease comprises substitutions selected from the group consisting of: E164R, N270A, N549R, K554R, K560R, Q819L, E164R/K554R, E164R/K560R, K554R/K560R, E164R/K554R/K560R, E164R/K560R/N270A, and N549R/Q819L.

Provided herein are engineered nucleases comprising an amino acid sequence having at least 90% or at least 95% identity to SEQ ID NO: 334 and one, two, three, four, five, or six substitutions at positions selected from the group consisting of: 165, 273, 586, 591, 597, and 853. In some embodiments, the engineered nuclease comprises substitutions at positions selected from the group consisting of: 165, 273, 586, 591, 597, 853, 165/591, 165/597, 591/597, 165/591/597, 165/597/273, and 586/853. In some embodiments, the engineered nuclease comprises one, two, three, four, five, or six substitutions selected from the group consisting of: Q165R, N273A, N586R, N591R, K597R, and Q853L. In some embodiments, the engineered nuclease comprises substitutions selected from the group consisting of: Q165R, N273A, N586R, N591R, K597R, Q853L, Q165R/N591R, Q165R/K597R, N591R/K597R, Q165R/N591R/K597R, Q165R/K597R/N273A, and N586R/Q853L.

Provided herein are engineered nucleases comprising an amino acid sequence having at least 90% or at least 95% identity to SEQ ID NO: 342 and one, two, three, four, five, or six substitutions at positions selected from the group consisting of: 163, 269, 557, 562, 568, and 860. In some embodiments, the engineered nuclease comprises substitutions at positions selected from the group consisting of: 163, 269, 557, 562, 568, 860, 163/562, 163/568, 562/568, 163/562/568, 163/568/269, and 557/860. In some embodiments, the engineered nuclease comprises one, two, three, four, five, or six substitutions selected from the group consisting of: E163R, N269A, N557R, N562R, K568R, and Q860L. In some embodiments, the engineered nuclease comprises substitutions selected from the group consisting of: E163R, N269A, N557R, K568R, Q860L, E163R/N562R, E163R/K568R, N562R/K568R, E163R/N562R/K568R, E163R/K568R/N269A, and N557R/Q860L.

Provided herein are engineered nucleases comprising an amino acid sequence having at least 90% or at least 95% identity to SEQ ID NO: 350 and one, two, three, four, five, or six substitutions at positions selected from the group consisting of: 168, 274, 560, 565, 571, and 829. In some embodiments, the engineered nuclease comprises substitutions at positions selected from the group consisting of: 168, 274, 560, 565, 571, 829, 168/565, 168/571, 565/571, 168/565/571, 168/571/274, and 560/829. In some embodiments, the engineered nuclease comprises one, two, three, four, five, or six substitutions selected from the group consisting of: Q168R, N274A, N560R, G565R, K571R, and Q829L. In some embodiments, the engineered nuclease comprises substitutions selected from the group consisting of: Q168R, N274A, N560R, G565R, K571R, Q829L, Q168R/G565R, Q168R/K571R, G565R/K571R, Q168R/G565R/K571R, Q168R/K571R/N274A, and N560R/Q829L.

Provided herein are engineered nucleases comprising an amino acid sequence having at least 90% or at least 95% identity to SEQ ID NO: 357 and one, two, three, four, five, or six substitutions at positions selected from the group consisting of: 165, 271, 557, 562, 568, and 823. In some embodiments, the engineered nuclease comprises substitutions at positions selected from the group consisting of: 165, 271, 557, 562, 568, 823, 165/562, 165/568, 562/568, 165/562/568, 165/568/271, and 557/823. In some embodiments, the engineered nuclease comprises one, two, three, four, five, or six substitutions selected from the group consisting of: E165R, N271A, N557R, G562R, K568R, and Q823L. In some embodiments, the engineered nuclease comprises substitutions selected from the group consisting of: E165R, N271A, N557R, G562R, K568R, Q823, E165R/G562R, E165R/K568R, G562R/K568R, E165R/G562R/K568R, E165R/K568R/N271A, and N557R/Q823.

Provided herein are engineered nucleases comprising an amino acid sequence having at least 90% or at least 95% identity to SEQ ID NO: 363 with one, two, three, four, five, or six substitutions at positions selected from the group consisting of: 189, 295, 580, 585, 591, and 870. In some embodiments, the engineered nuclease comprises substitutions at positions selected from the group consisting of: 189, 295, 580, 585, 591, 870, 189/585, 189/591, 585/591, 189/585/591, 189/591/295, and 580/870. In some embodiments, the engineered nuclease comprises one, two, three, four, five, or six substitutions selected from the group consisting of: D189R, N295A, T580R, N585R, Q591R, and Q870L. In some embodiments, the engineered nuclease comprises substitutions selected from the group consisting of: D189R, N295A, T580R, N585R, Q591R, Q870L, D189R/N585R, D189R/Q591R, N585R/Q591R, D189R/N585R/Q591R, D189R/Q591R/N295A, and T580R/Q870L.

Provided herein are engineered nucleases comprising an amino acid sequence having at least 90% or at least 95% identity to SEQ ID NO: 360 and one, two, three, four, five, or six substitutions at positions selected from the group consisting of: 189, 295, 580, 585, 591, and 870. In some embodiments, the engineered nuclease comprises substitutions at positions selected from the group consisting of: 189, 295, 580, 585, 591, 870, 189/585, 189/591, 585/591, 189/585/591, 189/591/295, and 580/870. In some embodiments, the engineered nuclease comprises one, two, three, four, five, or six substitutions selected from the group consisting of: D189R, N295A, T580R, K585R, Q591R, and Q870L. In some embodiments, the engineered nuclease comprises substitutions selected from the group consisting of: D189R, N295A, T580R, K585R, Q591R, Q870L, D189R/K585R, D189R/Q591R, K585R/Q591R, D189R/K585R/Q591R, D189R/Q591R/N295A, and T580R/Q870L.

Provided herein are engineered nucleases comprising an amino acid sequence having at least 90% or at least 95% identity to SEQ ID NO: 53 and one, two, three, four, five, or six substitutions at positions selected from the group consisting of: 167, 275, 584, 589, 595, and 871. In some embodiments, the engineered nuclease comprises substitutions at positions selected from the group consisting of: 167, 275, 584, 589, 595, 871, 167/589, 167/595, 589/595, 167/589/595, 167/595/275, and 584/871. In some embodiments, the engineered nuclease comprises one, two, three, four, five, or six substitutions selected from the group consisting of: K167R, N275A, S584R, Q589R, K595R, and H871L. In some embodiments, the engineered nuclease comprises substitutions selected from the group consisting of: K167R, N275A, S584R, Q589R, K595R, H871L, K167R/Q589R, K167R/K595R, Q589R/K595R, K167R/Q589R/K595R, K167R/K595R/N275A, and S584R/H871L.

Provided herein are engineered nucleases comprising an amino acid sequence having at least 90% or at least 95% identity to SEQ ID NO: 380 and one, two, three, four, five, or six substitutions at positions selected from the group consisting of: 160, 265, 540, 545, 551, and 840. In some embodiments, the engineered nuclease comprises substitutions at positions selected from the group consisting of: 160, 265, 540, 545, 551, 840, 160/545, 160/551, 545/551, 160/545/551, 160/551/8265, and 540/840. In some embodiments, the engineered nuclease comprises one, two, three, four, five, or six substitutions selected from the group consisting of: E160R, N265A, N540R, D545R, K551R, and E840L. In some embodiments, the engineered nuclease comprises substitutions selected from the group consisting of: E160R, N265A, N540R, D545R, K551R, E840L, E160R/D545R, E160R/K551R, D545R/K551R, E160R/D545R/K551R, E160R/K551R/N265A, and N540R/E840L.

Provided herein are engineered nucleases comprising an amino acid sequence having at least 90% or at least 95% identity to SEQ ID NO: 383 with one, two, three, four, five, or six substitutions at positions selected from the group consisting of: 160, 265, 540, 545, 551, and 840. In some embodiments, the engineered nuclease comprises substitutions at positions selected from the group consisting of: 160, 265, 540, 545, 551, 840, 160/545, 160/551, 545/551, 160/545/551, 160/551/265, and 540/840. In some embodiments, the engineered nuclease comprises one, two, three, four, five, or six substitutions selected from the group consisting of: E160R, N265A, N540R, D545R, N551R, and E840L. In some embodiments, the engineered nuclease comprises substitutions selected from the group consisting of: E160R, N265A, N540R, D545R, N551R, E840L, E160R/D545R, E160R/N551R, D545R/N551R, E160R/D545R/N551R, E160R/N551R/N265A, and N540R/E840L.

Provided herein are engineered nucleases comprising an amino acid sequence having at least 90% or at least 95% identity to SEQ ID NO: 386 with one, two, three, four, five, or six substitutions at positions selected from the group consisting of: 168, 274, 565, 570, 576, and 841. In some embodiments, the engineered nuclease comprises substitutions at positions selected from the group consisting of: 168, 274, 565, 570, 576, 841, 168/570, 168/576, 570/576, 168/570/576, 168/576/274, and 565/841. In some embodiments, the engineered nuclease comprises one, two, three, four, five, or six substitutions selected from the group consisting of: T168R, N274A, N565R, S570R, Y576R, and D841L. In some embodiments, the engineered nuclease comprises substitutions selected from the group consisting of: T168R, N274A, N565R, S570R, Y576R, D841L, T168R/S570R, T168R/Y576R, S570R/Y576R, T168R/S570R/Y576R, T168R/Y576R/N274A, and N565R/D841L.

Provided herein are engineered nucleases comprising an amino acid sequence having at least 90% or at least 95% identity to SEQ ID NO: 15 and one, two, three, four, or five substitutions at positions selected from the group consisting of: 163, 275, 576, 581, and 587. In some embodiments, the engineered nuclease comprises substitutions at positions selected from the group consisting of: 163, 275, 576, 581, 587, 163/581, 163/587, 581/587, 163/581/587, and 163/587/275. In some embodiments, the engineered nuclease comprises one, two, three, four, or five substitutions selected from the group consisting of: E163R, N275A, N576R, D581R, and K587R. In some embodiments, the engineered nuclease comprises selected from the group consisting of: E163R, N275A, N576R, D581R, K587R, E163R/D581R, E163R/K587R, D581R/K587R, E163R/D581R/K587R, and E163R/K587R/N275A.

Provided herein are engineered nucleases comprising an amino acid sequence having at least 90% or at least 95% identity to SEQ ID NO: 65 and one, two, three, four, or five substitutions at positions selected from the group consisting of: 170, 276, 552, 557, and 563. In some embodiments, the engineered nuclease comprises substitutions at positions selected from the group consisting of: 170, 276, 552, 557, 563, 170/557, 170/563, 557/563, 170/557/563, and 170/563/276. In some embodiments, the engineered nuclease comprises one, two, three, four, or five substitutions selected from the group consisting of: Q170R, N276A, N552R, K557R, and K563R. In some embodiments, the engineered nuclease comprises substitutions selected from the group consisting of: Q170R, N276A, N552R, K557R, K563R, Q170R/K557R, Q170R/K563R, K557R/K563R, Q170R/K557R/K563R, and Q170R/K563R/N276A.

Provided herein are engineered nucleases comprising an amino acid sequence having at least 90% or at least 95% identity to SEQ ID NO: 69 and one, two, three, four, or five substitutions at positions selected from the group consisting of: 163, 269, 545, 550, and 556. In some embodiments, the engineered nuclease comprises substitutions at positions selected from the group consisting of: 163, 269, 545, 550, 556, 163/550, 163/556, 550/556, 163/550/556, and 163/556/269. In some embodiments, the engineered nuclease comprises one, two, three, four, or five substitutions selected from the group consisting of: Q163R, N269A, C545R, N550R, and F556R. In some embodiments, the engineered nuclease comprises substitutions selected from the group consisting of: Q163R, N269A, C545R, N550R, F556R, Q163R/N550R, Q163R/F556R, N550R/F556R, Q163R/N550R/F556R, and Q163R/F556R/N269A.

Provided herein are engineered nucleases comprising an amino acid sequence having at least 90% or at least 95% identity to SEQ ID NO: 434 and one, two, three, four, or five substitutions at positions selected from the group consisting of: 154, 249, 521, 527, and 533. In some embodiments, the engineered nuclease comprises substitutions at positions selected from the group consisting of: 154, 249, 521,527, 533, 154/527, 154/533, 527/533, 154/527/533, and 154/533/249. In some embodiments, the engineered nuclease comprises one, two, three, four, or five substitutions selected from the group consisting of: D154R, N249A, N521R, S527R, and Q533R. In some embodiments, the engineered nuclease comprises substitutions selected from the group consisting of: D154R, N249A, N521R, S527R, Q533R, D154R/S527R, D154R/Q533R, S527R/Q533R, D154R/S527R/Q533R, and D154R/Q533R/N249A.

Provided herein are engineered nucleases comprising an amino acid sequence having at least 90% or at least 95% identity to SEQ ID NO: 319 and one, two, three, four, five, or six substitutions at positions selected from the group consisting of: 163, 269, 557, 562, 568, and 825. In some embodiments, the engineered nuclease comprises substitutions at positions selected from the group consisting of: 163, 269, 557, 562, 568, 825, 163/562, 163/568, 562/568, 163/562/568, 163/568/269, and 557/825. In some embodiments, the engineered nuclease comprises one, two, three, four, five, or six substitutions selected from the group consisting of: E163R, N269A, N557R, N562R, K568R, and Q825L. In some embodiments, the engineered nuclease comprises substitutions selected from the group consisting of: E163R, N269A, N557R, N562R, K568R, Q825L, E163R/N562R, E163R/K568R, N562R/K568R, E163R/N562R/K568R, E163R/K568R/N269A, and N557R/Q825L.

Provided herein are engineered nucleases comprising an amino acid sequence having at least 90% or at least 95% identity to SEQ ID NO: 327 and one, two, three, four, five, or six substitutions at positions selected from the group consisting of: 164, 270, 549, 554, 560, and 819. In some embodiments, the engineered nuclease comprises substitutions at positions selected from the group consisting of: 164, 270, 549, 554, 560, 819, 164/554, 164/560, 554/560, 164/554/560, 164/560/270, and 549/819. In some embodiments, the engineered nuclease comprises one, two, three, four, five, or six substitutions selected from the group consisting of: E164R, N270A, N549R, N554R, K560R, and Q819L. In some embodiments, the engineered nuclease comprises substitutions selected from the group consisting of: E164R, N270A, N549R, N554R, K560R, Q819L, E164R/N554R, E164R/K560R, N554R/K560R, E164R/N554R/K560R, E164R/K560R/N270A, and N549R/Q819L.

Provided herein are engineered nucleases comprising an amino acid sequence having at least 90% or at least 95% identity to SEQ ID NO: 29 and one, two, three, four, five, or six substitutions at positions selected from the group consisting of: 177, 285, 550, 555, 561, and 883. In some embodiments, the engineered nuclease comprises substitutions at positions selected from the group consisting of: 177, 284, 550, 555, 561, 883, 177/555, 177/561, 555/561, 177/555/561, 177/561/285, and 550/883. In some embodiments, the engineered nuclease comprises one, two, three, four, five, or six substitutions selected from the group consisting of: E177R, N285A, F550R, D555R, K561R, and F883L. In some embodiments, the engineered nuclease comprises substitutions selected from the group consisting of: E177R, N285A, F550R, D555R, K561R, F883L, E177R/D555R, E177R/K561R, D555R/K561R, E177R/D555R/K561R, E177R/K561R/N285A, and F550R/F883L.

Provided herein are engineered nucleases comprising an amino acid sequence having at least 90% or at least 95% identity to SEQ ID NO: 430 and one, two, or three substitutions at positions selected from the group consisting of: 343, 348, and 354. In some embodiments, the engineered nuclease comprises substitutions at positions selected from the group consisting of: 343, 348, 354, and 348/354. In some embodiments, the engineered nuclease comprises one, two, or three substitutions selected from the group consisting of: N343R, A348R, and K354R. In some embodiments, the engineered nuclease comprises substitutions selected from the group consisting of: N343R, A348R, K354R, and A348R/K354R.

Provided herein are engineered nucleases comprising an amino acid sequence having at least 90% or at least 95% identity to SEQ ID NO: 112 and one, two, three, four, or five substitutions at positions selected from the group consisting of: 253, 357, 714, 719, and 725. In some embodiments, the engineered nuclease comprises substitutions at positions selected from the group consisting of: 253, 357, 714, 719, 725, 253/719, 253/725, 719/725, 253/719/725, and 253/725/357. In some embodiments, the engineered nuclease comprises one, two, three, four, or five substitutions selected from the group consisting of: E253R, N357A, Y714R, D719R, and N725R. In some embodiments, the engineered nuclease comprises substitutions selected from the group consisting of: E253R, N357A, Y714R, D719R, N725R, E253R/D719R, E253R/N725R, D719R/N725R, E253R/D719R/N725R, and E253R/N725R/N357A.

Provided herein are engineered nucleases comprising an amino acid sequence having at least 90% or at least 95% identity to SEQ ID NO: 293 and one, two, three, four, five, or six substitutions at positions selected from the group consisting of: 257, 362, 720, 725, 731, and 1057. In some embodiments, the engineered nuclease comprises substitutions at positions selected from the group consisting of: 257, 362, 720, 725, 731, 1057, 257/725, 257/731, 725/731, 257/725/731, 257/731/362, and 720/1057. In some embodiments, the engineered nuclease comprises one, two, three, four, five, or six substitutions selected from the group consisting of: E257R, N362A, N720R, G725R, T731R, and I1057L. In some embodiments, the engineered nuclease comprises substitutions selected from the group consisting of: E257R, N362A, N720R, G725R, T731R, I1057L, E257R/G725R, E257R/T731R, G725R/T731R, E257R/G725R/T731R, E257R/T731R/N362A, and N720R/I1057L.

Provided herein are engineered nucleases comprising an amino acid sequence having at least 90% or at least 95% identity to SEQ ID NO: 29 and one or more of SEQ ID NOs: 1115-1120.

Provided herein are engineered nucleases comprising an amino acid sequence having at least 90% or at least 95% identity to SEQ ID NO: 333 and one or more of SEQ ID NOs: 1121-1126.

Provided herein are engineered nucleases comprising an amino acid sequence having at least 90% or at least 95% identity to SEQ ID NO: 347 and one or more of SEQ ID NOs: 1127-1132.

Provided herein are engineered nucleases comprising an amino acid sequence having at least 90% or at least 95% identity to SEQ ID NO: 351 and one or more of SEQ ID NOs: 1133-1138.

Provided herein are engineered nucleases comprising an amino acid sequence having at least 90% or at least 95% identity to SEQ ID NO: 73 and one or more of SEQ ID NOs: 1139-1144.

Provided herein are engineered nucleases comprising an amino acid sequence having at least 90% or at least 95% identity to SEQ ID NO: 77 and one or more of SEQ ID NOs: 1145-1150.

Provided herein are engineered nucleases comprising an amino acid sequence having at least 90% or at least 95% identity to SEQ ID NO: 432 and one or more of SEQ ID NOs: 1151-1156.

Provided herein are engineered nucleases comprising an amino acid sequence having at least 90% or at least 95% identity to SEQ ID NO: 434 and one or more of SEQ ID NOs: 1157-1162.

Provided herein are engineered nucleases comprising an amino acid sequence having at least 90% or at least 95% identity to SEQ ID NO: 327 and one or more of SEQ ID NOs: 1163-1168.

Provided herein are engineered nucleases comprising an amino acid sequence having at least 90% or at least 95% identity to SEQ ID NO: 416 and one or more of SEQ ID NOs: 1169-1174.

Provided herein are engineered nucleases comprising an amino acid sequence having at least 90% or at least 95% identity to SEQ ID NO: 420 and one or more of SEQ ID NOs: 1175-1180.

Provided herein are engineered nucleases comprising an amino acid sequence having at least 90% or at least 95% identity to SEQ ID NO: 341 and one or more of SEQ ID NOs: 1181-1186.

Provided herein are engineered nucleases comprising an amino acid sequence having at least 90% or at least 95% identity to SEQ ID NO: 15 and one or more of SEQ ID NOs: 1187-1192.

Provided herein are engineered nucleases comprising an amino acid sequence having at least 90% or at least 95% identity to SEQ ID NO: 65 and one or more of SEQ ID NOs: 1193-1198.

Provided herein are engineered nucleases comprising an amino acid sequence having at least 90% or at least 95% identity to SEQ ID NO: 414 and one or more of SEQ ID NOs: 1199-1204.

Provided herein are engineered nucleases comprising an amino acid sequence having at least 90% or at least 95% identity to SEQ ID NO: 77 and one or more of SEQ ID NOs: 1205-1210.

Provided herein are engineered nucleases comprising an amino acid sequence having at least 90% or at least 95% identity to SEQ ID NO: 461 and one or more of SEQ ID NOs: 1211-1216.

Provided herein are engineered nucleases comprising an amino acid sequence having at least 90% or at least 95% identity to SEQ ID NO: 380 and one or more of SEQ ID NOs: 1217-1222.

Provided herein are engineered nucleases comprising an amino acid sequence having at least 90% or at least 95% identity to SEQ ID NO: 383 and one or more of SEQ ID NOs: 1219-1224.

Provided herein are engineered nucleases wherein the engineered nuclease has at least one amino acid substitution, deletion, or addition as compared to SEQ ID NOs: 1-5, 8-465, 1063-1070, 1080-1081 and 1095. In some embodiments, the engineered nuclease has an enlarged PAM sequence preference as compared to a nuclease not having the at least one amino acid substitution, deletion, or addition. In some embodiments, the engineered nuclease has a reduced PAM sequence preference as compared to a nuclease not having the at least one amino acid substitution, deletion, or addition. In some embodiments, the engineered nuclease has an increased editing efficiency as compared to a nuclease not having the at least one amino acid substitution, deletion, or addition.

In some embodiments, the nuclease further comprises a nuclear localization sequence (NLS), an epitope tag, a fusion with a protein or protein domain, or a combination thereof.

Also provided herein are nucleic acids encoding the disclosed engineered nucleases and vectors comprising the nucleic acid. In some embodiments, the vector further comprises a promoter operatively linked to the nucleic acid. In some embodiments, the vector further comprises a nucleic acid encoding a guide RNA (gRNA). In some embodiments, the vector further comprises a promoter operatively linked to the nucleic acid encoding a guide RNA (gRNA).

Compositions and systems comprising the engineered nucleases are additionally provided. In some embodiments, the compositions or systems further comprise at least one guide RNA (gRNA) or a one or more nucleic acids comprising a sequence encoding the gRNA.

In some embodiments, the at least one gRNA comprises a non-naturally occurring gRNA. In some embodiments, the at least one gRNA is encoded in a CRISPR RNA array.

In some embodiments, the nucleic acid molecule encoding each one or both of the nuclease and the gRNA is a DNA molecule, such as a vector, plasmid, or linear nucleic acid. In some embodiments, the nuclease is encoded in a messenger RNA. In some embodiments, the gRNA is comprised in a small RNA. In some embodiments, the nuclease and the gRNA are encoded on the same nucleic acid. In some embodiments, the nuclease and the gRNA are encoded on different nucleic acids.

In some embodiments, the system further comprises a target nucleic acid.

In some embodiments, the system is a cell-free system.

Provided herein are compositions comprising a nuclease, wherein the nuclease comprises a sequence with at least 70%, 80%, 85%, 90%, 95%, 96%, 97%, 98%, 99% or greater than 99% identity to any one of SEQ ID NOs: 1-1096. In some embodiments, the amino acid sequence of the engineered nuclease comprises any one of SEQ ID NOs: 1-1096.

In some embodiments, the nuclease is comprised in a fusion protein of a peptide or protein fused to the engineered nuclease. In some embodiments, the peptide comprises a nuclear localization sequence (NLS) at the N- or C-terminus of the engineered nuclease.

Also provided are nucleic acid molecules comprising a first sequence encoding the nuclease or the fusion protein disclosed herein and vectors comprising the nucleic acid molecules. In some embodiments, the vector further comprises a promoter operatively linked to the first sequence. In some embodiments, the vector further comprises a second nucleic acid encoding a guide RNA (gRNA). In some embodiments, the vector further comprises a promoter operatively linked to the second nucleic acid.

Additionally provided are systems for modifying a first target nucleic acid comprising: a) a nuclease comprising an amino acid sequence having 70%, 80%, 85%, 90%, 95%, 96%, 97%, 98%, 99%, greater than 99% or 100% identity to any of SEQ ID NOs: 1-1096 or a first nucleic acid sequence encoding the engineered nuclease; and b) an engineered guide RNA (gRNA) comprising a first region configured to interact with the engineered protein and a second region configured to hybridize with a portion of the first target nucleic acid or a second nucleic acid sequence encoding the gRNA.

In some embodiments, the nuclease in the presence of the gRNA is capable of modifying the first target nucleic acid. In some embodiments, modifying comprises nucleic acid cleavage. In some embodiments, the modifying comprises one or more of nucleic acid binding, base editing, transcription modulation, nucleic acid modification, protein modification, and histone modification.

In some embodiments, the gRNA further comprises a third region configured to hybridize with a portion of a second target nucleic acid.

In some embodiments, a peptide or protein is fused to the engineered nuclease. In some embodiments, the peptide comprises a nuclear localization sequence (NLS) at the N- or C-terminus of the engineered nuclease. In some embodiments, the peptide comprises a purification tag sequence at the N- or C-terminus of the engineered nuclease.

In some embodiments, the system further comprises a target nucleic acid.

In some embodiments, the system is a cell-free system.

Also provided are vectors comprising the disclosed system. In some embodiments, the vector further comprises a first promoter operatively linked to the first nucleic acid sequence and a second promoter operatively linked to the second nucleic acid sequence. In some embodiments, the vector is a viral vector. In some embodiments, the first promoter and the second promoter are active in a mammalian cell.

Also provided are cells comprising the disclosed compositions and systems. In some embodiments, the cell is a prokaryotic cell. In some embodiments, the cell is a eukaryotic cell (e.g., a mammalian cell or a human cell).

Further provided are methods for modifying a target nucleic acid comprising contacting the target nucleic acid with a nuclease, composition or system described herein. In some embodiments, the methods comprise contacting the target nucleic acid with a targeting composition comprising a composition, a nucleic acid, a vector, or a system as disclosed herein.

In some embodiments, the target nucleic acid sequence is in a cell. In some embodiments, the cell is a prokaryotic cell. In some embodiments, the cell is a eukaryotic cell (e.g., a mammalian cell or a human cell).

In some embodiments, introducing the system or composition into the cell comprises administering the system or composition to a subject. In some embodiments, administering comprises in vivo administration. In some embodiments, administering comprises transplantation of ex vivo treated cells comprising the system or composition.

Additionally provided are methods of generating a cell that expresses a recombinant receptor comprising introducing into the cell: a nuclease as disclosed herein or a nucleic acid molecule comprising a sequence encoding the nuclease; at least one guide RNA (gRNA) complementary to at least a portion of a target nucleic acid or a nucleic acid comprising a sequence encoding the at least one gRNA; and a nucleic acid encoding the recombinant receptor. In some embodiments, the nucleic acid encoding the recombinant receptor is integrated into genomic DNA of the cell.

In some embodiments, the recombinant receptor is a T cell receptor (TCR) or a chimeric antigen receptor (CAR). In some embodiments, the system and the recombinant receptor are encoded by separate nucleic acids.

In some embodiments, the cell is a T cell. In some embodiments, the T cell is from a subject. In some embodiments, the T cell is expanded in vitro.

Also provided are T cells comprising the disclosed nuclease, composition or system and a recombinant receptor or a nucleic acid encoding the recombinant receptor. In some embodiments, the T cell is from a subject.

Provided herein are methods for modifying a target nucleic acid in a plant. The methods comprise providing to the plant, or a plant cell, seed, fruit, plant part, or propagation material of the plant a nuclease, composition or system described herein, and at least one gRNA complementary to at least a portion of the target nucleic acid or a nucleic acid comprising a sequence encoding the at least one gRNA. In some embodiments, the methods further comprise providing to the plant a donor polynucleotide. In some embodiments, the nucleic acid encodes a gene product.

In some embodiments, the plant is a grain crop, a fruit crop, a forage crop, a root vegetable crop, a leafy vegetable crop, a flowering plant, a conifer, an oil crop, a plant used in phytoremediation, an industrial crop, a medicinal crop, or a laboratory model plant.

In some embodiments, the nucleic acid molecule comprising a sequence encoding the nuclease and the at least one gRNA or the nucleic acid encoding the at least one guide RNA are provided via *Agrobacterium*-mediated transformation.

In some embodiments, the method confers one or more of the following traits to the plant or a plant cell, seed, fruit, plant part, or propagation material of the plant: herbicide tolerance, drought tolerance, male sterility, insect resistance, abiotic stress tolerance, modified fatty acid metabolism, modified carbohydrate metabolism, modified seed yield, modified oil percent, modified protein content, disease resistance, cold and frost tolerance, improved taste, increased germination, increased micronutrient uptake, improved flower longevity, modified fragrance, modified nutritional value, modified fruit or flower size or number, modified growth, and modified plant size.

Provided herein are method for treating a disease or disorder in a subject. In some embodiments, the methods comprise administering to the subject a nuclease, composition or system described herein, and at least one gRNA complementary to at least a portion of the target nucleic acid or a nucleic acid comprising a sequence encoding the at least one gRNA, or cell as described herein. In some embodiments, the methods comprise administering to the subject: a nuclease comprising an amino acid sequence having at least 70% identity, at least 80% identity, at least 90% identity, at least 95% identity or at least 99% identity to any of SEQ ID NOs: 1-1096 or a nucleic acid molecule comprising a sequence encoding the nuclease; and at least one guide RNA (gRNA) complementary to at least a portion of a target nucleic acid or a nucleic acid comprising a sequence encoding the at least one gRNA; or a cell comprising a recombinant receptor or a nucleic acid encoding the recombinant receptor, the nuclease, or a nucleic acid encoding thereof, and at least one gRNA, or a nucleic acid encoding thereof. In some embodiments, the subject is a human.

In some embodiments, the nucleic acid molecule encoding each one or both of the nuclease and the at least one gRNA comprises a messenger RNA, a vector, or a combination thereof. In some embodiments, the nuclease and the at least one gRNA are encoded on a single nucleic acid. In some embodiments, the nuclease further comprises a nuclear localization sequence (NLS).

In some embodiments, the at least one gRNA comprises a non-naturally occurring gRNA. In some embodiments, the at least one gRNA is encoded in a CRISPR RNA array.

In some embodiments, the cell is a T cell. In some embodiments, the T cell is from a subject. In some embodiments, the T cell is expanded in vitro. In some embodiments, the nucleic acid encoding the recombinant receptor is integrated into genomic DNA of the cell.

In some embodiments, the target nucleic acid is a disease-associated gene.

In some embodiments, the methods further comprise administering a donor polynucleotide. In some embodiments, the donor polynucleotide comprises a therapeutic protein, functional gene product, or a combination thereof.

In some embodiments, the methods further comprise administering a therapeutic agent.

Kits comprising any or all of the components of the compositions or systems described herein are also provided. In some embodiments, the kit further comprises one or more reagent, shipping and/or packaging containers, one or more buffers, a delivery device, instructions, software, a computing device, or a combination thereof.

Other aspects and embodiments of the disclosure will be apparent in light of the following detailed description.

DETAILED DESCRIPTION

Figure 1:
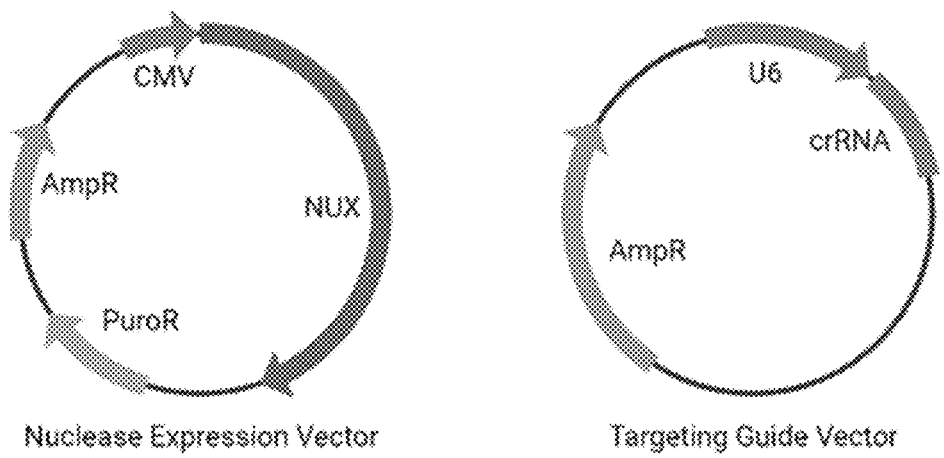
FIG. 1 is vector diagrams of an exemplary nuclease expression vector and an exemplary targeting guide vector.

The disclosed compositions, systems, kits, and methods comprise nucleases useful for nucleic acid modification. The disclosed nucleases allow for high precision gene editing with improved efficacy and safety for use in in vivo and ex vivo applications of eukaryotic (e.g., mammalian (e.g., human)) therapeutics, diagnostics, and research.

Section headings as used in this section and the entire disclosure herein are merely for organizational purposes and are not intended to be limiting.

Definitions

The terms "comprise(s)," "include(s)," "having," "has," "can," "contain(s)," and variants thereof, as used herein, are intended to be open-ended transitional phrases, terms, or words that do not preclude the possibility of additional acts or structures. As used herein, comprising a certain sequence or a certain SEQ ID NO usually implies that at least one copy of said sequence is present in recited peptide or polynucleotide. However, two or more copies are also contemplated. The singular forms "a," "and," and "the" include plural references unless the context clearly dictates otherwise. The present disclosure also contemplates other embodiments "comprising," "consisting of," and "consisting essentially of," the embodiments or elements presented herein, whether explicitly set forth or not.

For the recitation of numeric ranges herein, each intervening number there between with the same degree of precision is explicitly contemplated. For example, for the range of 6-9, the numbers 7 and 8 are contemplated in addition to 6 and 9, and for the range 6.0-7.0, the number 6.0, 6.1, 6.2, 6.3, 6.4, 6.5, 6.6, 6.7, 6.8, 6.9, and 7.0 are explicitly contemplated.

Unless otherwise defined herein, scientific, and technical terms used in connection with the present disclosure shall have the meanings that are commonly understood by those of ordinary skill in the art. For example, any nomenclature used in connection with, and techniques of cell and tissue culture, molecular biology, microbiology, genetics and protein and nucleic acid chemistry and hybridization described herein are those that are well known and commonly used in the art. The meaning and scope of the terms should be clear; in the event, however of any latent ambiguity, definitions provided herein take precedent over any dictionary or extrinsic definition. Further, unless otherwise required by context, singular terms shall include pluralities and plural terms shall include the singular.

As used herein, "nucleic acid" or "nucleic acid sequence" refers to a polymer or oligomer of pyrimidine and/or purine bases, preferably cytosine, thymine, and uracil, and adenine and guanine, respectively (See Albert L. Lehninger, Principles of Biochemistry, at 793-800 (Worth Pub. 1982)). The present technology contemplates any deoxyribonucleotide, ribonucleotide, or peptide nucleic acid component, and any chemical variants thereof, such as methylated, hydroxymethylated, or glycosylated forms of these bases, and the like. The polymers or oligomers may be heterogenous or homogenous in composition and may be isolated from naturally occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states. In some embodiments, a nucleic acid or nucleic acid sequence comprises other kinds of nucleic acid structures such as, for instance, a DNA/RNA helix, peptide nucleic acid (PNA), morpholino nucleic acid (see, e.g., Braasch and Corey, Biochemistry, 41 (14): 4503-4510 (2002)) and U.S. Pat. No. 5,034,506), locked nucleic acid (LNA; see Wahlestedt et al., Proc. Natl. Acad. Sci. U.S.A., 97:5633-5638 (2000)), cyclohexenyl nucleic acids (see Wang, J. Am. Chem. Soc., 122:8595-8602 (2000)), and/or a ribozyme. Hence, the term "nucleic acid" or "nucleic acid sequence" may also encompass a chain comprising non-natural nucleotides, modified nucleotides, and/or non-nucleotide building blocks that can exhibit the same function as natural nucleotides (e.g., "nucleotide analogs"); further, the term "nucleic acid sequence" as used herein refers to an oligonucleotide, nucleotide or polynucleotide, and fragments or portions thereof, and to DNA or RNA of genomic or synthetic origin, which may be single or double-stranded, and represent the sense or antisense strand. The terms "nucleic acid," "polynucleotide," "nucleotide sequence," and "oligonucleotide" are used interchangeably. They refer to a polymeric form of nucleotides of any length, either deoxyribonucleotides or ribonucleotides, or analogs thereof.

Nucleic acid or amino acid sequence "identity," as described herein, can be determined by comparing a nucleic acid or amino acid sequence of interest to a reference nucleic acid or amino acid sequence. The percent identity is the number of nucleotides or amino acid residues that are the same (e.g., that are identical) as between the sequence of interest and the reference sequence divided by the length of the longest sequence (e.g., the length of either the sequence of interest or the reference sequence, whichever is longer). A number of mathematical algorithms for obtaining the optimal alignment and calculating identity between two or more sequences are known and incorporated into a number of available software programs. Examples of such programs include CLUSTAL-W, T-Coffee, and ALIGN (for alignment of nucleic acid and amino acid sequences), BLAST programs (e.g., BLAST 2.1, BL2SEQ, and later versions thereof) and FASTA programs (e.g., FASTA3×, FAS™, and SSEARCH) (for sequence alignment and sequence similarity searches). Sequence alignment algorithms also are disclosed in, for example, Altschul et al., *J. Molecular Biol.,* 215 (3): 403-410 (1990), Beigert et al., *Proc. Natl. Acad. Sci. USA,* 106 (10): 3770-3775 (2009), Durbin et al., eds., *Biological Sequence Analysis: Probabilistic Models of Proteins and Nucleic Acids,* Cambridge University Press, Cambridge, UK (2009), Soding, *Bioinformatics,* 21 (7): 951-960

(2005), Altschul et al., *Nucleic Acids Res.,* 25 (17): 3389-3402 (1997), and Gusfield, *Algorithms on Strings, Trees and Sequences,* Cambridge University Press, Cambridge UK (1997)).

The terms "non-naturally occurring," "engineered," and "synthetic" are used interchangeably and indicate the involvement of the hand of man. The terms, when referring to nucleic acid molecules or polypeptides mean that the nucleic acid molecule or the polypeptide is at least substantially free from at least one other component with which it is naturally associated in nature and as found in nature, and/or the nucleic acid molecule or the polypeptide is associated with at least one other component with which it is not naturally associated in nature and/or that there is one or more changes in nucleic acid or amino acid sequence as compared with such sequence as it is found in nature.

A "vector" or "expression vector" is a replicon, such as plasmid, phage, virus, or cosmid, to which another DNA segment, e.g., an "insert," may be attached or incorporated so as to bring about the replication of the attached segment in a cell.

A cell has been "genetically modified," "transformed," or "transfected" by exogenous DNA, e.g., a recombinant expression vector, when such DNA has been introduced inside the cell. The presence of the exogenous DNA results in permanent or transient genetic change. The transforming DNA may or may not be integrated (covalently linked) into the genome of the cell. For example, the transforming DNA may be maintained on an episomal element such as a plasmid. With respect to eukaryotic cells, a stably transformed cell is one in which the transforming DNA has become integrated into a chromosome so that it is inherited by daughter cells through chromosome replication. This stability is demonstrated by the ability of the eukaryotic cell to establish cell lines or clones that comprise a population of daughter cells containing the transforming DNA. A "clone" is a population of cells derived from a single cell or common ancestor by mitosis. A "cell line" is a clone of a primary cell that is capable of stable growth in vitro for many generations.

The term "contacting" as used herein refers to bring or put in contact, to be in or come into contact. The term "contact" as used herein refers to a state or condition of touching or of immediate or local proximity. Contacting a composition to a target destination, such as, but not limited to, an organ, tissue, cell, or tumor, may occur by any means of administration known to the skilled artisan.

As used herein, the terms "providing," "administering," and "introducing," are used interchangeably herein and refer to the placement of the composition or systems of the disclosure into a cell, organism, or subject by a method or route which results in at least partial localization to a desired site. The composition or systems can be administered by any appropriate route which results in delivery to a desired location in the cell, organism, or subject.

Preferred methods and materials are described below, although methods and materials similar or equivalent to those described herein can be used in practice or testing of the present disclosure. All publications, patent applications, patents and other references mentioned herein are incorporated by reference in their entirety. The materials, methods, and examples disclosed herein are illustrative only and not intended to be limiting.

Nucleases

Advances and developments in CRISPR-Cas genome editing tools including nucleases and other Cas protein drive major advances in nucleic acid editing. Nucleic acid editing has many uses including in the diagnostics and therapeutics field. Such breadth is accompanied by a diversity of nucleic acid targets and environments in which to engineer editing activity. As such, there is a need for diverse and additional nucleases and associated methods that provide a toolbox for nucleic acid editing.

Disclosed herein are compositions that include nucleases that have Cas-like activity. Unless otherwise noted herein, "nucleases" as used herein includes and encompasses the described "engineered nucleases." The disclosed nucleases comprise a sequence having at least 70% identity (e.g., at least 75%, at least 80%, at least 85%, at least 90%, at least 93%, at least 95%, at least 98%, or at least 99%) to an amino acid sequence of SEQ ID NOs: 1-5, 8-465, 1063-1070, 1080-1081, and 1095. In some embodiments, the nuclease comprises a sequence having at least 90% identity an amino acid sequence of SEQ ID NOs: 1-5, 8-465, 1063-1070, 1080-1081, and 1095. In certain embodiments, the nuclease comprises an amino acid sequence of SEQ ID NOs: 1-1096. In some embodiments, the amino acid sequence of the nuclease lacks identity or significant amino acid homology with certain known Cas nucleases. In some embodiments, the amino acid sequence of the nuclease lacks identity or significant amino acid homology with Cas12a (Cpf1) protein. In some embodiments, the amino acid sequence of the nuclease lacks identity or significant amino acid homology with a Cas9 such as SaCas9 or SpyCas9. In some embodiments, the amino acid sequence of the nuclease has less than 50%, less than 48%, less than 45%, less than 40%, less than 35% or less than 34% with Cas12a (Cpf1) protein, SaCas9 or SpyCas9 proteins.

Any of the nucleases described herein may comprise one or more (e.g., 1, 2, 3, 4, 5, 6, 7, 8, 9, 10, 15, 20, 25, 50, 100, 150, 200, etc.) amino acid substitutions. An amino acid "replacement" or "substitution" refers to the replacement of one amino acid at a given position or residue by another amino acid at the same position or residue within a polypeptide sequence. Amino acids are broadly grouped as "aromatic" or "aliphatic." An aromatic amino acid includes an aromatic ring. Examples of "aromatic" amino acids include histidine (H or His), phenylalanine (F or Phe), tyrosine (Y or Tyr), and tryptophan (W or Trp). Non-aromatic amino acids are broadly grouped as "aliphatic." Examples of "aliphatic" amino acids include glycine (G or Gly), alanine (A or Ala), valine (V or Val), leucine (L or Leu), isoleucine (I or Ile), methionine (M or Met), serine (S or Ser), threonine (T or Thr), cysteine (C or Cys), proline (P or Pro), glutamic acid (E or Glu), aspartic acid (A or Asp), asparagine (N or Asn), glutamine (Q or Gln), lysine (K or Lys), and arginine (R or Arg).

The amino acid replacement or substitution can be conservative, semi-conservative, or non-conservative. The phrase "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz and Schirmer, Principles of Protein Structure, Springer-Verlag, New York (1979)). According to such analyses, groups of amino acids may be defined where amino acids within a group exchange preferentially with each other, and therefore resemble each other most in their impact on the overall protein structure (Schulz and Schirmer, supra). Examples of conservative amino acid substitutions include substitutions of amino acids within the sub-groups described above, for example, lysine for arginine and vice versa such that a positive charge may be maintained, glutamic acid for aspartic acid and vice versa such that a negative charge may be maintained, serine for threonine such that a free-OH can be maintained, and glutamine for asparagine such that a free —NH$_2$ can be maintained. "Semi-conservative mutations" include amino acid substitutions of amino acids within the same groups listed above, but not within the same sub-group. For example, the substitution of aspartic acid for asparagine, or asparagine for lysine, involves amino acids within the same group, but different sub-groups. "Non-conservative mutations" involve amino acid substitutions between different groups, for example, lysine for tryptophan, or phenylalanine for serine, etc.

Herein, substitutions or substitution positions separated by a "/" represent a nuclease or engineered nuclease having each of the substitution or a substitution at each of the recited positions. For example, a nuclease comprising substitutions at positions 164/564 represents an engineered nuclease comprising substitutions at positions 164 and 564, based on the recited sequence.

In some embodiments, one or more amino acid substitutions in the amino acid sequence of a nuclease results in an increase in editing efficiency (e.g., an increase in cleavage, modification of a target nucleic acid) relative to the nuclease without the one or more amino acid substitutions. In some cases, one or more amino acid substitutions in the amino acid sequence of a nuclease results in detectable editing efficiency where the nuclease without the one or more amino acid substitutions has no detectable or minimally detectable editing ability. In some embodiments, one or more amino acid substitutions in the amino acid sequence of a nuclease results in an alteration of preferred PAM sequences, such that the where the nuclease without the one or more amino acid substitutions can utilize an expanded set of protospacer adjacent motif (PAM) sequences as compared to the nuclease without the one or more amino acid substitutions.

In some embodiments, a nuclease comprises one or more amino acid substitutions and has an amino acid sequence having at least 70% identity (e.g., at least 75%, at least 80%, at least 85%, at least 90%, at least 93%, at least 95%, at least 98%, or at least 99% identity) to an amino acid sequence of SEQ ID NOs: 1-1096. In some embodiments, a nuclease comprises one or more amino acid substitutions as compared to SEQ ID NOs: 1-1096, wherein the one or more substitutions improves the editing efficiency of the nuclease.

The engineered nuclease may comprise an amino acid sequence having at least 90% or at least 95% identity to SEQ ID NO: 328 with one, two, three, four, five, or six substitutions at positions selected from the group consisting of: 164, 271, 559, 564, 570, and 827. In some embodiments, the engineered nuclease comprises substitutions at positions selected from the group consisting of: 164, 559, 564, 570, 827, 164/564, 164/570, 564/570, 164/564/570, 164/570/271, and 559/827. In some embodiments, the engineered nuclease comprises, two, three, four, five, or six substitutions selected from the group consisting of: K164R, N271A, N559R, N564R, N570R, and Q827L. In some embodiments, the engineered nuclease comprises substitutions selected from the group consisting of: K164R, N564R, N570R, K164R/N564R, K164R/N570R, N564R/N570R, K164R/N564R/N570R, K164R/N570R/N271A, N559R, Q827L, and N559R/Q827L.

The engineered nuclease may comprise an amino acid sequence having at least 90% or at least 95% identity to SEQ ID NO: 333 with one, two, three, four, five, or six substitutions at positions selected from the group consisting of: 165, 271, 560, 565, 572, and 829. In some embodiments, the engineered nuclease comprises substitutions at positions selected from the group consisting of: 165, 560, 565, 572, 829, 165/565, 165/572, 165/565/572, 165/572/271, and 560/829. In some embodiments, the engineered nuclease comprises one, two, three, four, five, or six substitutions selected from the group consisting of: E165R, N271A, N560R, K565R, K572R, and Q829L. In some embodiments, the engineered nuclease comprises substitutions selected from the group consisting of: E165R, N560R, K565R, K572R, Q829L, E165R/K565R, E165R/K572R, E165R/K565R/K572R, E165R/K572R/N271A, and N560R/Q829L.

The engineered nuclease may comprise an amino acid sequence having at least 90% or at least 95% identity to SEQ ID NO: 325 with one, two, three, four, five, or six substitutions at positions selected from the group consisting of: 163, 269, 590, 595, 600, and 860. In some embodiments, the engineered nuclease comprises substitutions at positions selected from the group consisting of: 165, 590, 595, 600, 860, 163/595, 163/600, 595/600, 163/595/600, 163/595/269, and 590/860. In some embodiments, the engineered nuclease comprises one, two, three, four, five, or six substitutions selected from the group consisting of: E163R, N269A, N590R, D595R, K600R, and Q860L. In some embodiments, the engineered nuclease comprises substitutions selected from the group consisting of: E163R, N590R, D595R, K600R, Q860L, E163R/D595R, E163R/K600R, D595R/K600R, E163R/D595R/K600R, E163R/D595R/N269A, and N590R/Q860L.

The engineered nuclease may comprise an amino acid sequence having at least 90% or at least 95% identity to SEQ ID NO: 339 with one, two, three, four, five, or six substitutions at positions selected from the group consisting of: 163, 260, 532, 537, 544, and 801. In some embodiments, the engineered nuclease comprises substitutions at positions selected from the group consisting of: 163, 260, 532, 537, 544, 801, 163/537, 163/644, 537/544, 163/537/544, 163/544/260, and 532/801. In some embodiments, the engineered nuclease comprises one, two, three, four, five, or six substitutions selected from the group consisting of: Q163R, N260A, S532R, D537R, K544R, and Q801L. In some embodiments, the engineered nuclease comprises substitutions selected from the group consisting of: Q163R, N260A, S532R, D537R, K544R, Q801L, Q163R/D537R, Q163R/K544R, D537R/K544R, Q163R/D537R/D544R, Q163R/D544R/N260A, and S532R/Q801L.

The engineered nuclease may comprise an amino acid sequence having at least 90% or at least 95% identity to SEQ ID NO: 336 with one, two, three, four, five, or six substitutions at positions selected from the group consisting of: 153, 259, 546, 551, 557, and 815. In some embodiments, the engineered nuclease comprises substitutions at positions selected from the group consisting of: 153, 259, 546, 551, 557, 815, 153/551, 153/557, 551/557, 153/551/557, 153/557/259, and 546/815. In some embodiments, the engineered nuclease comprises one, two, three, four, five, or six substitutions selected from the group consisting of: K153R, N259A, N546R, G551R, K557R, and Q815L. In some embodiments, the engineered nuclease comprises substitutions selected from the group consisting of: K153R, N259A, N546R, G551R, K557R, Q815L, K153R/G551R, K153R/K557R, G551R/K557R, K153R/G551R/K557R, K153R/K557R/N259A, and N546R/Q815L.

The engineered nuclease may comprise an amino acid sequence having at least 90% or at least 95% identity to SEQ ID NO: 348 with one, two, three, four, five, or six substitutions at positions selected from the group consisting of:

160, 267, 554, 559, 565, and 832. In some embodiments, the engineered nuclease comprises substitutions at positions selected from the group consisting of: 160, 267, 554, 559, 565, 832, 160/559, 160/565, 559/565, 160/559/565, 160/565/267, and 554/832. In some embodiments, the engineered nuclease comprises one, two, three, four, five, or six substitutions selected from the group consisting of: E160R, N267A, N554R, N559R, K565R, and Q832L. In some embodiments, the engineered nuclease comprises substitutions selected from the group consisting of: E160R, N267A, N554R, N559R, K565R, Q832L, E160R/N559R, E160R/K565R, N559R/K565R, E160R/N559R/K565R, E160R/K565R/N267A, and N554R/Q832L.

The engineered nuclease may comprise an amino acid sequence having at least 90% or at least 95% identity to SEQ ID NO: 341 with one, two, three, four, five, or six substitutions at positions selected from the group consisting of: 156, 262, 536, 541, 547, and 805. In some embodiments, the engineered nuclease comprises substitutions at positions selected from the group consisting of: 156, 262, 536, 541, 547, 805, 156/541, 156/547, 541/547, 156/541/547, 156/547/262, and 536/805. In some embodiments, the engineered nuclease comprises one, two, three, four, five, or six substitutions selected from the group consisting of: E156R, N262A, K536R, N541R, K547R, and Q805L. In some embodiments, the engineered nuclease comprises substitutions selected from the group consisting of: E156R, N262A, K536R, N541R, K547R, Q805L, E156R/N541R, E156R/K547R, N541R/K547R, E156R/N541R/K547R, E156R/K547R/N262A, and K536R/Q805L.

The engineered nuclease may comprise an amino acid sequence having at least 90% or at least 95% identity to SEQ ID NO: 346 with one, two, three, four, five, or six substitutions at positions selected from the group consisting of: 166, 271, 548, 553, 559, and 817. In some embodiments, the engineered nuclease comprises substitutions at positions selected from the group consisting of: 166, 271, 548, 553, 559, 817, 166/553, 166/559, 553/559, 166/553/559, 166/559/271, and 548/817. In some embodiments, the engineered nuclease comprises one, two, three, four, five, or six substitutions selected from the group consisting of: E166R, N271A, N548R, G553R, K559R, and Q817L. In some embodiments, the engineered nuclease comprises substitutions selected from the group consisting of: E166R, N271A, N548R, G553R, K559R, Q817L, E166R/G553R, E166R/K559R, G553R/K559R, E166R/G553R/K559R, E166R/K559R/N271A, and N548R/Q817L.

The engineered nuclease may comprise an amino acid sequence having at least 90% or at least 95% identity to SEQ ID NO: 347 with one, two, three, four, five, or six substitutions at positions selected from the group consisting of: 166, 273, 563, 568, 574, and 866. In some embodiments, the engineered nuclease comprises substitutions at positions selected from the group consisting of: 166, 273, 563, 568, 574, 866, 166/568, 166/574, 568/574, 166/568/574, 166/574/273, and 536/866. In some embodiments, the engineered nuclease comprises one, two, three, four, five, or six substitutions selected from the group consisting of: E166R, N273A, N563R, K568R, K574R, and Q866L. In some embodiments, the engineered nuclease comprises substitutions selected from the group consisting of: E166R, N273A, N563R, K568R, K574R, Q866L, E166R/K568R, E166R/K574R, K568R/K574R, E166R/K568R/K574R, E166R/K574R/N273A, and N563R/Q866L.

The engineered nuclease may comprise an amino acid sequence having at least 90% or at least 95% identity to SEQ ID NO: 351 with one, two, three, four, or five substitutions at positions selected from the group consisting of: 157, 263, 547, 553, and 811. In some embodiments, the engineered nuclease comprises substitutions at positions selected from the group consisting of: 157, 263, 547, 553, 811, 157/547, 157/553, 547/553, 157/547/553, and 157/553/263. In some embodiments, the engineered nuclease comprises one, two, three, four, or five substitutions selected from the group consisting of: E157R, N263A, A547R, K553R, and Q811L. In some embodiments, the engineered nuclease comprises substitutions selected from the group consisting of: E157R, N263A, A547R, K553R, Q811L, E157R/A547R, E157R/K553R, A547R/K553R, E157R/A547R/K553R, and E157R/K553R/N263A.

The engineered nuclease may comprise an amino acid sequence having at least 90% or at least 95% identity to SEQ ID NO: 364 with one, two, three, four, five, or six substitutions at positions selected from the group consisting of: 153, 252, 508, 513, 519, and 771. In some embodiments, the engineered nuclease comprises substitutions at positions selected from the group consisting of: 153, 252, 508, 513, 519, 771, 153/513, 153/519, 513/519, 153/513/519, 153/519/252, and 508/771. In some embodiments, the engineered nuclease comprises one, two, three, four, five, or six substitutions selected from the group consisting of: T153R, N252A, T508R, N513R, N519R, and Q771L. In some embodiments, the engineered nuclease comprises substitutions selected from the group consisting of: T153R, N252A, T508R, N513R, N519R, Q771L, T153R/N513R, T153R/N519R, T153R/N519R, T153R/N513R/N519R, T153R/N519R/N252A, and T508R/Q771L.

The engineered nuclease may comprise an amino acid sequence having at least 90% or at least 95% identity to SEQ ID NO: 373 with one, two, three, four, five, or six substitutions at positions selected from the group consisting of: 161, 267, 550, 555, 561, and 852. In some embodiments, the engineered nuclease comprises substitutions at positions selected from the group consisting of: 161, 267, 550, 555, 561, 852, 161/555, 161/561, 161/555/561, 161/561/267, and 550/852. In some embodiments, the engineered nuclease comprises one, two, three, four, five, or six substitutions selected from the group consisting of: E161R, N267A, N550R, D555R, K561R, and Q852L. In some embodiments, the engineered nuclease comprises substitutions selected from the group consisting of: E161R, N267A, N550R, D555R, K561R, Q852L, E161R/D555R, E161R/K561R, E161R/D555R/K561R, E161R/K561R/N267A, and N550R/Q852L.

The engineered nuclease may comprise an amino acid sequence having at least 90% or at least 95% identity to SEQ ID NO: 359 with one, two, three, four, five, or six substitutions at positions selected from the group consisting of: 157, 260, 527, 532, 538, and 797. In some embodiments, the engineered nuclease comprises substitutions at positions selected from the group consisting of: 157, 260, 527, 532, 538, 797, 157/532, 157/538, 157/532/527, 157/538/260, and 527/797. In some embodiments, the engineered nuclease comprises one, two, three, four, five, or six substitutions selected from the group consisting of: E157R, N260A, N527R, V532R, K538R, and S797L. In some embodiments, the engineered nuclease comprises substitutions selected from the group consisting of: E157R, N260A, N527R, V532R, K538R, S797L, E157R/V532R, E157R/K538R, E157R/V532R/N527R, E157R/K538R/N260A, and N527R/S797L.

The engineered nuclease may comprise an amino acid sequence having at least 90% or at least 95% identity to SEQ ID NO: 370 with one, two, three, four, or five substitutions at positions selected from the group consisting of: 187, 280, 559, 564, and 849. In some embodiments, the engineered nuclease comprises substitutions at positions selected from the group consisting of: 187, 280, 559, 564, 849, 187/564, 187/280, and 559/849. In some embodiments, the engineered nuclease comprises, two, three, four, or five substitutions selected from the group consisting of: D187R, N280A, T559R, N564R, and Q849L. In some embodiments, the engineered nuclease comprises substitutions selected from the group consisting of: D187R, N280A, T559R, N564R, Q849L, D187R/N564R, D187R/N280A, and T559R/Q849L.

The engineered nuclease may comprise an amino acid sequence having at least 90% or at least 95% identity to SEQ ID NO: 374 with one, two, three, four, or five substitutions at positions selected from the group consisting of: 165, 271, 551, 556, and 562. In some embodiments, the engineered nuclease comprises substitutions at positions selected from the group consisting of: 165, 271, 551, 556, 562, 165/556, 165/562, 566/562, 165/556/562, and 165/562/271. In some embodiments, the engineered nuclease comprises one, two, three, four, or five substitutions selected from the group consisting of: E165R, N271A, N551R, D556R, and K562R. In some embodiments, the engineered nuclease comprises substitutions selected from the group consisting of: E165R, N271A, N551R, D556R, K562R, E165R/D556R, E165R/K562R, D556R/K562R, E165R/D556R/K562R, and E165R/K562R/N271A.

The engineered nuclease may comprise an amino acid sequence having at least 90% or at least 95% identity to SEQ ID NO: 375 with one, two, three, four, or five substitutions at positions selected from the group consisting of: 165, 271, 557, 562, and 850. In some embodiments, the engineered nuclease comprises substitutions at positions selected from the group consisting of: 165, 271, 557, 562, 850, 165/562, 165/271, and 557/850. In some embodiments, the engineered nuclease comprises one, two, three, four, or five substitutions selected from the group consisting of: Q165R, N271A, S557R, K562R, and Q850L. In some embodiments, the engineered nuclease comprises substitutions selected from the group consisting of: Q165R, N271A, S557R, K562R, Q850L, Q165R/K562R, Q165R/N271A, and S557R/Q850L.

The engineered nuclease may comprise an amino acid sequence having at least 90% or at least 95% identity to SEQ ID NO: 318 with one, two, three, four, five, or six substitutions at positions selected from the group consisting of: 166, 273, 562, 567, 573, and 830. In some embodiments, the engineered nuclease comprises substitutions at positions selected from the group consisting of: 166, 273, 562, 567, 573, 830, 166/567, 166/573, 567/573, 166/567/573, 166/573/273, and 562/830. In some embodiments, the engineered nuclease comprises one, two, three, four, five, or six substitutions selected from the group consisting of: E166R, N273A, N562R, D567R, K573R, and H830L. In some embodiments, the engineered nuclease comprises substitutions selected from the group consisting of: E166R, N273A, N562R, D567R, K573R, H830L, E166R/D567R, E166R/K573R, D567R/K573R, E166R/D567R/K573R, E166R/K573R/N273A, and N562R/H830L.

The engineered nuclease may comprise an amino acid sequence having at least 90% or at least 95% identity to SEQ ID NO: 28 with one, two, three, four, five, or six substitutions at positions selected from the group consisting of: 178, 283, 597, 602, 608, and 896. In some embodiments, the engineered nuclease comprises substitutions at positions selected from the group consisting of: 178, 283, 597, 602, 608, 896, 178/602, 178/608, 602/608, 178/602/608, 178/608/283, and 597/896. In some embodiments, the engineered nuclease comprises one, two, three, four, five, or six substitutions selected from the group consisting of: E178R, N283A, T597R, N602R, K608R, and Q896L. In some embodiments, the engineered nuclease comprises substitutions selected from the group consisting of: E178R, N283A, T597R, N602R, K608R, Q896L, E178R/N602R, E178R/K608R, N602R/K608R, E178R/N602R/K608R, E178R/K608R/N283A, and T597R/Q896L.

The engineered nuclease may comprise an amino acid sequence having at least 90% or at least 95% identity to SEQ ID NO: 409 with one, two, three, four, five, or six substitutions at positions selected from the group consisting of: 156, 261, 539, 544, 550, and 829. In some embodiments, the engineered nuclease comprises substitutions at positions selected from the group consisting of: 156, 261, 539, 544, 550, 829, 156/544, 156/550, 544/550, 156/544/550, 156/550/261, and 539/829. In some embodiments, the engineered nuclease comprises one, two, three, four, five, or six substitutions selected from the group consisting of: K156R, N261A, N539R, K544R, L550R, and S829L. In some embodiments, the engineered nuclease comprises substitutions selected from the group consisting of: K156R, N261A, N539R, K544R, L550R, S829L, K156R/K544R, K156R/L550R, K544R/L550R, K156R/K544R/L550R, K156R/L550R/N261A, and N539R/S829L.

The engineered nuclease may comprise an amino acid sequence having at least 90% or at least 95% identity to SEQ ID NO: 416 with one, two, three, four, five, or six substitutions at positions selected from the group consisting of: 178, 286, 541, 546, 552, and 873. In some embodiments, the engineered nuclease comprises substitutions at positions selected from the group consisting of: 178, 286, 541, 546, 552, 873, 178/546, 178/552, 546/552, 178/546/552, 178/552/286, and 541/873. In some embodiments, the engineered nuclease comprises one, two, three, four, five, or six substitutions selected from the group consisting of: E178R, N286A, N541R, D546R, K552R, and F873L. In some embodiments, the engineered nuclease comprises substitutions selected from the group consisting of: E178R, N286A, N541R, D546R, K552R, F873L, E178R/D546R, E178R/K552R, D546R/K552R, E178R/D546R/K552R, E178R/K552R/N286A, and N541R/F873L.

The engineered nuclease may comprise an amino acid sequence having at least 90% or at least 95% identity to SEQ ID NO: 420 with one, two, three, four, or five substitutions at positions selected from the group consisting of: 167, 279, 580, 585, and 591. In some embodiments, the engineered nuclease comprises substitutions at positions selected from the group consisting of: 167, 279, 580, 585, 591, 167/585, 167/591, 585/591, 167/585/591, and 167/591/279. In some embodiments, the engineered nuclease comprises one, two, three, four, or five substitutions selected from the group consisting of: E167R, N279A, S580R, N585R, and N591R. In some embodiments, the engineered nuclease comprises substitutions selected from the group consisting of: E167R, N279A, S580R, N585R, N591R, E167R/N585R, E167R/N591R, N585R/N591R, E167R/N585R/N591R, and E167R/N591R/N279A.

The engineered nuclease may comprise an amino acid sequence having at least 90% or at least 95% identity to SEQ ID NO: 394 with one, two, three, four, five, or six substitutions at positions selected from the group consisting of: 150, 245, 516, 521, 527, and 900. In some embodiments, the engineered nuclease comprises substitutions at positions selected from the group consisting of: 150, 245, 516, 521, 527, 900, 150/521, 150/527, 521/527, 150/521/527, 150/527/245, and 516/900. In some embodiments, the engineered nuclease comprises one, two, three, four, five, or six substitutions selected from the group consisting of: Q150R, N245A, C516R, N521R, K527R, and Q900L. In some embodiments, the engineered nuclease comprises substitutions selected from the group consisting of: Q150R, N245A, C516R, N521R, K527R, Q900L, Q150R/N521R, Q150R/K527R, N521R/K527R, Q150R/N521R/K527R, Q150R/K527R/N245A, and C516R/Q900L.

The engineered nuclease may comprise an amino acid sequence having at least 90% or at least 95% identity to SEQ ID NO: 396 with one, two, three, four, five, or six substitutions at positions selected from the group consisting of: 207, 300, 587, 592, 598, and 787. In some embodiments, the engineered nuclease comprises substitutions at positions selected from the group consisting of: 207, 300, 587, 592, 598, 787, 207/592, 207/598, 592/598, 207/592/598, 207/598/300, and 587/787. In some embodiments, the engineered nuclease comprises one, two, three, four, five, or six substitutions selected from the group consisting of: E207R, N300A, N587R, D592R, K598R, and F787L. In some embodiments, the engineered nuclease comprises selected from the group consisting of: E207R, N300A, N587R, D592R, K598R, F787L, E207R/D592R, E207R/K598R, D592R/K598R, E207R/D592R/K598R, E207R/K598R/N300A, and N587R/F787L.

The engineered nuclease may comprise an amino acid sequence having at least 90% or at least 95% identity to SEQ ID NO: 414 with one, two, three, four, or five substitutions at positions selected from the group consisting of: 168, 274, 553, 558, and 564. In some embodiments, the engineered nuclease comprises substitutions at positions selected from the group consisting of: 168, 274, 553, 558, 564, 168/558, 168/564, 558/564, 168/558/564, and 168/564/274. In some embodiments, the engineered nuclease comprises one, two, three, four, or five substitutions selected from the group consisting of: Q168R, N274A, C553R, N558R, and F564R. In some embodiments, the engineered nuclease comprises substitutions selected from the group consisting of: Q168R, N274A, C553R, N558R, F564R, Q168R/N558R, Q168R/F564R, N558R/F564R, Q168R/N558R/F564R, and Q168R/F564R/N274A.

The engineered nuclease may comprise an amino acid sequence having at least 90% or at least 95% identity to SEQ ID NO: 404 with one, two, three, four, five, or six substitutions at positions selected from the group consisting of: 192, 298, 583, 589, 595, and 899. In some embodiments, the engineered nuclease comprises substitutions at positions selected from the group consisting of: 192, 298, 583, 589, 595, 899, 192/589, 192/595, 589/595, 192/589/595, 192/595/298, and 583/899. In some embodiments, the engineered nuclease comprises one, two, three, four, five, or six substitutions selected from the group consisting of: E192R, N298A, N583R, N589R, K595R, and Q899L. In some embodiments, the engineered nuclease comprises substitutions selected from the group consisting of: E192R, N298A, N583R, N589R, K595R, Q899L, E192R/N589R, E192R/K595R, N589R/K595R, E192R/N589R/K595R, E192R/K595R/N298A, and N583R/Q899L.

The engineered nuclease may comprise an amino acid sequence having at least 90% or at least 95% identity to SEQ ID NO: 73 with one, two, three, four, or five substitutions at positions selected from the group consisting of: 202, 307, 603, 608, and 614. In some embodiments, the engineered nuclease comprises substitutions at positions selected from the group consisting of: 202, 307, 603, 608, 614, 202/608, 202/614, and 202/608/614. In some embodiments, the engineered nuclease comprises one, two, three, four, or five substitutions selected from the group consisting of: N202R, N307A, D603R, N608R, and D614R. In some embodiments, the engineered nuclease comprises substitutions selected from the group consisting of: N202R, N307A, D603R, N608R, D614R, N202R/N608R, N202R/D614R, N202R/N608R/D614R, and N202R/D614R/N307A.

The engineered nuclease may comprise an amino acid sequence having at least 90% or at least 95% identity to SEQ ID NO: 77 with one, two, three, four, five, or six substitutions at positions selected from the group consisting of: 175, 283, 572, 577, 583, and 917. In some embodiments, the engineered nuclease comprises substitutions at positions selected from the group consisting of: 175, 283, 572, 577, 583, 917, 175/577, 175/583, 577/583, 175/577/583, 175/583/283, and 572/917. In some embodiments, the engineered nuclease comprises one, two, three, four, five, or six substitutions selected from the group consisting of: D175R, N283A, K572R, K577R, K583R, and F917L. In some embodiments, the engineered nuclease comprises substitutions selected from the group consisting of: D175R, N283A, K572R, K577R, K583R, F917L, D175R/K577R, D175R/K583R, K577R/K583R, D175R/K577R/K583R, D175R/K583R/N283A, and K572R/F917L.

The engineered nuclease may comprise an amino acid sequence having at least 90% or at least 95% identity to SEQ ID NO: 74 with one, two, three, four, or five substitutions at positions selected from the group consisting of: 163, 268, 527, 533, and 539. In some embodiments, the engineered nuclease comprises substitutions at positions selected from the group consisting of: 163, 268, 527, 533, 539, 163/533, 163/539, 533/539, 163/533/539, and 163/539/268. In some embodiments, the engineered nuclease comprises one, two, three, four, or five substitutions selected from the group consisting of: E163R, N268A, N527R, N533R, and K539R. In some embodiments, the engineered nuclease comprises substitutions selected from the group consisting of: E163R, N268A, N527R, N533R, K539R, E163R/N533R, E163R/K539R, N533R/K539R, E163R/N533R/K539R, and E163R/K539R/N268A.

The engineered nuclease may comprise an amino acid sequence having at least 90% or at least 95% identity to SEQ ID NO: 432 with one, two, three, four, five, or six substitutions at positions selected from the group consisting of: 180, 273, 552, 557, 563, and 857. In some embodiments, the engineered nuclease comprises substitutions at positions selected from the group consisting of: 180, 273, 552, 557, 563, 857, 180/557, 180/563, 557/563, 180/557/563, 180/563/273, and 552/857. In some embodiments, the engineered nuclease comprises one, two, three, four, five, or six substitutions selected from the group consisting of: E180R, N273A, S552R, N557R, K563R, and F857L. In some embodiments, the engineered nuclease comprises substitutions selected from the group consisting of: E180R, N273A, S552R, N557R, K563R, F857L, E180R/N557R, E180R/K563R, N557R/K563R, E180R/N557R/K563R, E180R/K563R/N273A, and S552R/F857L.

The engineered nuclease may comprise an amino acid sequence having at least 90% or at least 95% identity to SEQ ID NO: 437 with one, two, three, four, five, or six substitutions at positions selected from the group consisting of: 183, 281, 578, 583, 589, and 844. In some embodiments, the engineered nuclease comprises substitutions at positions selected from the group consisting of: 183, 281, 578, 583, 589, 844, 183/583, 183/589, 583/589, 183/583/589, 183/589/281, and 578/844. In some embodiments, the engineered nuclease comprises one, two, three, four, five, or six substitutions selected from the group consisting of: E183R, N281A, N578R, D583R, K589R, and F844L. In some embodiments, the engineered nuclease comprises substitutions selected from the group consisting of: E183R, N281A, N578R, D583R, K589R, F844L, E183R/D583R, E183R/K589R, D583R/K589R, E183R/D583R/K589R, E183R/K589R/N281A, and N578R/F844L.

The engineered nuclease may comprise an amino acid sequence having at least 90% or at least 95% identity to SEQ ID NO: 441 with one, two, three, four, five, or six substitutions at positions selected from the group consisting of: 165, 258, 497, 502, 508, and 794. In some embodiments, the engineered nuclease comprises substitutions at positions selected from the group consisting of: 165, 258, 497,502, 508, 794, 165/502, 165/508, 502/508, 165/502/508, 165/508/258, and 497/794. In some embodiments, the engineered nuclease comprises one, two, three, four, five, or six substitutions selected from the group consisting of: T165R, N258A, N497R, A502R, K508R, and E794L. In some embodiments, the engineered nuclease comprises substitutions selected from the group consisting of: T165R, N258A, N497R, A502R, K508R, E794L, T165R/A502R, T165R/K508R, A502R/K508R, T165R/A502R/K508R, T165R/K508R/N258A, and N497R/E794L.

The engineered nuclease may comprise an amino acid sequence having at least 90% or at least 95% identity to SEQ ID NO: 446 with one, two, three, four, or five substitutions at positions selected from the group consisting of: 195, 300, 647, 652, and 658. In some embodiments, the engineered nuclease comprises substitutions at positions selected from the group consisting of: 195, 300, 647, 652, 658, 195/652, 195/658, 652/658, 195/652/658, and 195/658/300. In some embodiments, the engineered nuclease comprises one, two, three, four, or five substitutions selected from the group consisting of: Q195R, N300A, Q647R, S652R, and K658R. In some embodiments, the engineered nuclease comprises substitutions selected from the group consisting of: Q195R, N300A, Q647R, S652R, K658R, Q195R/S652R, Q195R/K658R, S652R/K658R, Q195R/S652R/K658R, and Q195R/K658R/N300A.

The engineered nuclease may comprise an amino acid sequence having at least 90% or at least 95% identity to SEQ ID NO: 100 with one, two, three, four, five, or six substitutions at positions selected from the group consisting of: 185, 284, 585, 590, 596, and 825. In some embodiments, the engineered nuclease comprises substitutions at positions selected from the group consisting of: 185, 284, 585, 590, 596, 825, 185/590, 185/596, 590/596, 185/590/596, 185/596/284, and 585/825. In some embodiments, the engineered nuclease comprises one, two, three, four, five, or six substitutions selected from the group consisting of: N185R, N284A, H585R, G590R, K596R, and T825L. In some embodiments, the engineered nuclease comprises substitutions selected from the group consisting of: N185R, N284A, H585R, G590R, K596R, T825L, N185R/G590R, N185R/K596R, G590R/K596R, N185R/G590R/K596R, N185R/K596R/N284A, and H585R/T825L.

The engineered nuclease may comprise an amino acid sequence having at least 90% or at least 95% identity to SEQ ID NO: 104 with one, two, three, four, five, or six substitutions at positions selected from the group consisting of: 209, 316, 636, 641, 647, and 884. In some embodiments, the engineered nuclease comprises substitutions at positions selected from the group consisting of: 209, 316, 636, 641, 647, 884, 209/641, 209/647, 641/647, 209/641/647, 209/647/316, and 636/884. In some embodiments, the engineered nuclease comprises one, two, three, four, five, or six substitutions selected from the group consisting of: Q209R, N316A, N636R, G641R, Q647R, and F884L. In some embodiments, the engineered nuclease comprises substitutions selected from the group consisting of: Q209R, N316A, N636R, G641R, Q647R, F884L, Q209R/G641R, Q209R/Q647R, G641R/Q647R, Q209R/G641R/Q647R, Q209R/Q647R/N316A, and N636R/F884L.

The engineered nuclease may comprise an amino acid sequence having at least 90% or at least 95% identity to SEQ ID NO: 458 with one, two, three, four, five, or six substitutions at positions selected from the group consisting of: 180, 286, 589, 594, 600, and 853. In some embodiments, the engineered nuclease comprises substitutions at positions selected from the group consisting of: 180, 286, 589, 594, 600, 853, 180/594, 180/600, 594/600, 180/594/600, 180/600/286, and 589/853. In some embodiments, the engineered nuclease comprises one, two, three, four, five, or six substitutions selected from the group consisting of: T180R, N286A, N589R, G594R, E600R, and F853L. In some embodiments, the engineered nuclease comprises substitutions selected from the group consisting of: T180R, N286A, N589R, G594R, E600R, F853L, T180R/G594R, T180R/E600R, G594R/E600R, T180R/G594R/E600R, T180R/E600R/N286A, and N589R/F853L.

The engineered nuclease may comprise an amino acid sequence having at least 90% or at least 95% identity to SEQ ID NO: 461 with one, two, three, four, five, or six substitutions at positions selected from the group consisting of: 205, 309, 622, 627, 633, and 938. In some embodiments, the engineered nuclease comprises substitutions at positions selected from the group consisting of: 205, 309, 622, 627, 633, 938, 205/627, 205/633, 627/633, 205/627/633, 205/633/309, and 622/938. In some embodiments, the engineered nuclease comprises one, two, three, four, five, or six substitutions selected from the group consisting of: T205R, N309A, K622R, N627R, H633R, and I938L. In some embodiments, the engineered nuclease comprises substitutions selected from the group consisting of: T205R, N309A, K622R, N627R, H633R, I938L, T205R/N627R, T205R/H633R, N627R/H633R, T205R/N627R/H633R, T205R/H633R/N309A, and K622R/I938L.

The engineered nuclease may comprise an amino acid sequence having at least 90% or at least 95% identity to SEQ ID NO: 317 with one, two, three, four, five, or six substitutions at positions selected from the group consisting of: 157, 266, 551, 556, 562, and 820. In some embodiments, the engineered nuclease comprises substitutions at positions selected from the group consisting of: 157, 266, 551, 556, 562, 820, 157/556, 157/562, 556/562, 157/556/562, 157/562/266, and 551/820. In some embodiments, the engineered nuclease comprises one, two, three, four, five, or six substitutions selected from the group consisting of: E157R, N266A, N551R, D556R, K562R, and Q820L. In some embodiments, the engineered nuclease comprises substitutions selected from the group consisting of: E157R, N266A, N551R, D556R, K562R, Q820L, E157R/D556R, E157R/K562R, D556R/K562R, E157R/D556R/K562R, E157R/K562R/N266A, and N551R/Q820L.

The engineered nuclease may comprise an amino acid sequence having at least 90% or at least 95% identity to SEQ ID NO: 329 with one, two, three, four, five, or six substitutions at positions selected from the group consisting of: 164, 270, 549, 554, 560, and 819. In some embodiments, the engineered nuclease comprises substitutions at positions selected from the group consisting of: 164, 270, 549, 554, 560, 819, 164/554, 164/560, 554/560, 164/554/560, 164/

560/270, and 549/819. In some embodiments, the engineered nuclease comprises one, two, three, four, five, or six substitutions selected from the group consisting of: E164R, N270A, N549R, K554R, K560R, and Q819L. In some embodiments, the engineered nuclease comprises substitutions selected from the group consisting of: E164R, N270A, N549R, K554R, K560R, Q819L, E164R/K554R, E164R/K560R, K554R/K560R, E164R/K554R/K560R, E164R/K560R/N270A, and N549R/Q819L.

The engineered nuclease may comprise an amino acid sequence having at least 90% or at least 95% identity to SEQ ID NO: 334 with one, two, three, four, five, or six substitutions at positions selected from the group consisting of: 165, 273, 586, 591, 597, and 853. In some embodiments, the engineered nuclease comprises substitutions at positions selected from the group consisting of: 165, 273, 586, 591, 597, 853, 165/591, 165/597, 591/597, 165/591/597, 165/597/273, and 586/853. In some embodiments, the engineered nuclease comprises one, two, three, four, five, or six substitutions selected from the group consisting of: Q165R, N273A, N586R, N591R, K597R, and Q853L. In some embodiments, the engineered nuclease comprises substitutions selected from the group consisting of: Q165R, N273A, N586R, N591R, K597R, Q853L, Q165R/N591R, Q165R/K597R, N591R/K597R, Q165R/N591R/K597R, Q165R/K597R/N273A, and N586R/Q853L.

The engineered nuclease may comprise an amino acid sequence having at least 90% or at least 95% identity to SEQ ID NO: 342 with one, two, three, four, five, or six substitutions at positions selected from the group consisting of: 163, 269, 557, 562, 568, and 860. In some embodiments, the engineered nuclease comprises substitutions at positions selected from the group consisting of: 163, 269, 557, 562, 568, 860, 163/562, 163/568, 562/568, 163/562/568, 163/568/269, and 557/860. In some embodiments, the engineered nuclease comprises one, two, three, four, five, or six substitutions selected from the group consisting of: E163R, N269A, N557R, N562R, K568R, and Q860L. In some embodiments, the engineered nuclease comprises substitutions selected from the group consisting of: E163R, N269A, N557R, N562R, K568R, Q860L, E163R/N562R, E163R/K568R, N562R/K568R, E163R/N562R/K568R, E163R/K568R/N269A, and N557R/Q860L.

The engineered nuclease may comprise an amino acid sequence having at least 90% or at least 95% identity to SEQ ID NO: 350 with one, two, three, four, five, or six substitutions at positions selected from the group consisting of: 168, 274, 560, 565, 571, and 829. In some embodiments, the engineered nuclease comprises substitutions at positions selected from the group consisting of: 168, 274, 560, 565, 571, 829, 168/565, 168/571, 565/571, 168/565/571, 168/571/274, and 560/829. In some embodiments, the engineered nuclease comprises one, two, three, four, five, or six substitutions selected from the group consisting of: Q168R, N274A, N560R, G565R, K571R, and Q829L. In some embodiments, the engineered nuclease comprises substitutions selected from the group consisting of: Q168R, N274A, N560R, G565R, K571R, Q829L, Q168R/G565R, Q168R/K571R, G565R/K571R, Q168R/G565R/K571R, Q168R/K571R/N274A, and N560R/Q829L.

The engineered nuclease may comprise an amino acid sequence having at least 90% or at least 95% identity to SEQ ID NO: 357 with one, two, three, four, five, or six substitutions at positions selected from the group consisting of: 165, 271, 557, 562, 568, and 823. In some embodiments, the engineered nuclease comprises substitutions at positions selected from the group consisting of: 165, 271, 557, 562, 568, 823, 165/562, 165/568, 562/568, 165/562/568, 165/568/271, and 557/823. In some embodiments, the engineered nuclease comprises one, two, three, four, five, or six substitutions selected from the group consisting of: E165R, N271A, N557R, G562R, K568R, and Q823L. In some embodiments, the engineered nuclease comprises substitutions selected from the group consisting of: E165R, N271A, N557R, G562R, K568R, Q823, E165R/G562R, E165R/K568R, G562R/K568R, E165R/G562R/K568R, E165R/K568R/N271A, and N557R/Q823.

The engineered nuclease may comprise an amino acid sequence having at least 90% or at least 95% identity to SEQ ID NO: 363 with one, two, three, four, five, or six substitutions at positions selected from the group consisting of: 189, 295, 580, 585, 591, and 870. In some embodiments, the engineered nuclease comprises substitutions at positions selected from the group consisting of: 189, 295, 580, 585, 591, 870, 189/585, 189/591, 585/591, 189/585/591, 189/591/295, and 580/870. In some embodiments, the engineered nuclease comprises one, two, three, four, five, or six substitutions selected from the group consisting of: D189R, N295A, T580R, N585R, Q591R, and Q870L. In some embodiments, the engineered nuclease comprises substitutions selected from the group consisting of: D189R, N295A, T580R, N585R, Q591R, Q870L, D189R/N585R, D189R/Q591R, N585R/Q591R, D189R/N585R/Q591R, D189R/Q591R/N295A, and T580R/Q870L.

The engineered nuclease may comprise an amino acid sequence having at least 90% or at least 95% identity to SEQ ID NO: 360 with one, two, three, four, five, or six substitutions at positions selected from the group consisting of: 189, 295, 580, 585, 591, and 870. In some embodiments, the engineered nuclease comprises substitutions at positions selected from the group consisting of: 189, 295, 580, 585, 591, 870, 189/585, 189/591, 585/591, 189/585/591, 189/591/295, and 580/870. In some embodiments, the engineered nuclease comprises one, two, three, four, five, or six substitutions selected from the group consisting of: D189R, N295A, T580R, K585R, Q591R, and Q870L. In some embodiments, the engineered nuclease comprises substitutions selected from the group consisting of: D189R, N295A, T580R, K585R, Q591R, Q870L, D189R/K585R, D189R/Q591R, K585R/Q591R, D189R/K585R/Q591R, D189R/Q591R/N295A, and T580R/Q870L.

The engineered nuclease may comprise an amino acid sequence having at least 90% or at least 95% identity to SEQ ID NO: 53 with one, two, three, four, five, or six substitutions at positions selected from the group consisting of: 167, 275, 584, 589, 595, and 871. In some embodiments, the engineered nuclease comprises substitutions at positions selected from the group consisting of: 167, 275, 584, 589, 595, 871, 167/589, 167/595, 589/595, 167/589/595, 167/595/275, and 584/871. In some embodiments, the engineered nuclease comprises one, two, three, four, five, or six substitutions selected from the group consisting of: K167R, N275A, S584R, Q589R, K595R, and H871L. In some embodiments, the engineered nuclease comprises substitutions selected from the group consisting of: K167R, N275A, S584R, Q589R, K595R, H871L, K167R/Q589R, K167R/K595R, Q589R/K595R, K167R/Q589R/K595R, K167R/K595R/N275A, and S584R/H871L.

The engineered nuclease may comprise an amino acid sequence having at least 90% or at least 95% identity to SEQ ID NO: 380 with one, two, three, four, five, or six substitutions at positions selected from the group consisting of: 160, 265, 540, 545, 551, and 840. In some embodiments, the engineered nuclease comprises substitutions at positions selected from the group consisting of: 160, 265, 540, 545, 551, 840, 160/545, 160/551, 545/551, 160/545/551, 160/551/8265, and 540/840. In some embodiments, the engineered nuclease comprises one, two, three, four, five, or six substitutions selected from the group consisting of: E160R, N265A, N540R, D545R, K551R, and E840L. In some embodiments, the engineered nuclease comprises substitutions selected from the group consisting of: E160R, N265A, N540R, D545R, K551R, E840L, E160R/D545R, E160R/K551R, D545R/K551R, E160R/D545R/K551R, E160R/K551R/N265A, and N540R/E840L.

The engineered nuclease may comprise an amino acid sequence having at least 90% or at least 95% identity to SEQ ID NO: 383 with one, two, three, four, five, or six substitutions at positions selected from the group consisting of: 160, 265, 540, 545, 551, and 840. In some embodiments, the engineered nuclease comprises substitutions at positions selected from the group consisting of: 160, 265, 540, 545, 551, 840, 160/545, 160/551, 545/551, 160/545/551, 160/551/265, and 540/840. In some embodiments, the engineered nuclease comprises one, two, three, four, five, or six substitutions selected from the group consisting of: E160R, N265A, N540R, D545R, N551R, and E840L. In some embodiments, the engineered nuclease comprises substitutions selected from the group consisting of: E160R, N265A, N540R, D545R, N551R, E840L, E160R/D545R, E160R/N551R, D545R/N551R, E160R/D545R/N551R, E160R/N551R/N265A, and N540R/E840L.

The engineered nuclease may comprise an amino acid sequence having at least 90% or at least 95% identity to SEQ ID NO: 386 with one, two, three, four, five, or six substitutions at positions selected from the group consisting of: 168, 274, 565, 570, 576, and 841. In some embodiments, the engineered nuclease comprises substitutions at positions selected from the group consisting of: 168, 274, 565, 570, 576, 841, 168/570, 168/576, 570/576, 168/570/576, 168/576/274, and 565/841. In some embodiments, the engineered nuclease comprises one, two, three, four, five, or six substitutions selected from the group consisting of: T168R, N274A, N565R, S570R, Y576R, and D841L. In some embodiments, the engineered nuclease comprises substitutions selected from the group consisting of: T168R, N274A, N565R, S570R, Y576R, D841L, T168R/S570R, T168R/Y576R, S570R/Y576R, T168R/S570R/Y576R, T168R/Y576R/N274A, and N565R/D841L.

The engineered nuclease may comprise an amino acid sequence having at least 90% or at least 95% identity to SEQ ID NO: 15 with one, two, three, four, or five substitutions at positions selected from the group consisting of: 163, 275, 576, 581, and 587. In some embodiments, the engineered nuclease comprises substitutions at positions selected from the group consisting of: 163, 275, 576, 581, 587, 163/581, 163/587, 581/587, 163/581/587, and 163/587/275. In some embodiments, the engineered nuclease comprises one, two, three, four, or five substitutions selected from the group consisting of: E163R, N275A, N576R, D581R, and K587R. In some embodiments, the engineered nuclease comprises selected from the group consisting of: E163R, N275A, N576R, D581R, K587R, E163R/D581R, E163R/K587R, D581R/K587R, E163R/D581R/K587R, and E163R/K587R/N275A.

The engineered nuclease may comprise an amino acid sequence having at least 90% or at least 95% identity to SEQ ID NO: 65 with one, two, three, four, or five substitutions at positions selected from the group consisting of: 170, 276, 552, 557, and 563. In some embodiments, the engineered nuclease comprises substitutions at positions selected from the group consisting of: 170, 276, 552, 557, 563, 170/557, 170/563, 557/563, 170/557/563, and 170/563/276. In some embodiments, the engineered nuclease comprises one, two, three, four, or five substitutions selected from the group consisting of: Q170R, N276A, N552R, K557R, and K563R. In some embodiments, the engineered nuclease comprises substitutions selected from the group consisting of: Q170R, N276A, N552R, K557R, K563R, Q170R/K557R, Q170R/K563R, K557R/K563R, Q170R/K557R/K563R, and Q170R/K563R/N276A.

The engineered nuclease may comprise an amino acid sequence having at least 90% or at least 95% identity to SEQ ID NO: 69 with one, two, three, four, or five substitutions at positions selected from the group consisting of: 163, 269, 545, 550, and 556. In some embodiments, the engineered nuclease comprises substitutions at positions selected from the group consisting of: 163, 269, 545, 550, 556, 163/550, 163/556, 550/556, 163/550/556, and 163/556/269. In some embodiments, the engineered nuclease comprises one, two, three, four, or five substitutions selected from the group consisting of: Q163R, N269A, C545R, N550R, and F556R. In some embodiments, the engineered nuclease comprises substitutions selected from the group consisting of: Q163R, N269A, C545R, N550R, F556R, Q163R/N550R, Q163R/F556R, N550R/F556R, Q163R/N550R/F556R, and Q163R/F556R/N269A.

The engineered nuclease may comprise an amino acid sequence having at least 90% or at least 95% identity to SEQ ID NO: 434 with one, two, three, four, or five substitutions at positions selected from the group consisting of: 154, 249, 521, 527, and 533. In some embodiments, the engineered nuclease comprises substitutions at positions selected from the group consisting of: 154, 249, 521, 527, 533, 154/527, 154/533, 527/533, 154/527/533, and 154/533/249. In some embodiments, the engineered nuclease comprises one, two, three, four, or five substitutions selected from the group consisting of: D154R, N249A, N521R, S527R, and Q533R. In some embodiments, the engineered nuclease comprises substitutions selected from the group consisting of: D154R, N249A, N521R, S527R, Q533R, D154R/S527R, D154R/Q533R, S527R/Q533R, D154R/S527R/Q533R, and D154R/Q533R/N249A.

The engineered nuclease may comprise an amino acid sequence having at least 90% or at least 95% identity to SEQ ID NO: 319 with one, two, three, four, five, or six substitutions at positions selected from the group consisting of: 163, 269, 557, 562, 568, and 825. In some embodiments, the engineered nuclease comprises substitutions at positions selected from the group consisting of: 163, 269, 557, 562, 568, 825, 163/562, 163/568, 562/568, 163/562/568, 163/568/269, and 557/825. In some embodiments, the engineered nuclease comprises one, two, three, four, five, or six substitutions selected from the group consisting of: E163R, N269A, N557R, N562R, K568R, and Q825L. In some embodiments, the engineered nuclease comprises substitutions selected from the group consisting of: E163R, N269A, N557R, N562R, K568R, Q825L, E163R/N562R, E163R/K568R, N562R/K568R, E163R/N562R/K568R, E163R/K568R/N269A, and N557R/Q825L.

The engineered nuclease may comprise an amino acid sequence having at least 90% or at least 95% identity to SEQ ID NO: 327 with one, two, three, four, five, or six substitutions at positions selected from the group consisting of: 164, 270, 549, 554, 560, and 819. In some embodiments, the engineered nuclease comprises substitutions at positions selected from the group consisting of: 164, 270, 549, 554, 560, 819, 164/554, 164/560, 554/560, 164/554/560, 164/

560/270, and 549/819. In some embodiments, the engineered nuclease comprises one, two, three, four, five, or six substitutions selected from the group consisting of: E164R, N270A, N549R, N554R, K560R, and Q819L. In some embodiments, the engineered nuclease comprises substitutions selected from the group consisting of: E164R, N270A, N549R, N554R, K560R, Q819L, E164R/N554R, E164R/K560R, N554R/K560R, E164R/N554R/K560R, E164R/K560R/N270A, and N549R/Q819L.

The engineered nuclease may comprise an amino acid sequence having at least 90% or at least 95% identity to SEQ ID NO: 29 with one, two, three, four, five, or six substitutions at positions selected from the group consisting of: 177, 285, 550, 555, 561, and 883. In some embodiments, the engineered nuclease comprises substitutions at positions selected from the group consisting of: 177, 284, 550, 555, 561, 883, 177/555, 177/561, 555/561, 177/555/561, 177/561/285, and 550/883. In some embodiments, the engineered nuclease comprises one, two, three, four, five, or six substitutions selected from the group consisting of: E177R, N285A, F550R, D555R, K561R, and F883L. In some embodiments, the engineered nuclease comprises substitutions selected from the group consisting of: E177R, N285A, F550R, D555R, K561R, F883L, E177R/D555R, E177R/K561R, D555R/K561R, E177R/D555R/K561R, E177R/K561R/N285A, and F550R/F883L.

The engineered nuclease may comprise an amino acid sequence having at least 90% or at least 95% identity to SEQ ID NO: 430 with one, two, or three substitutions at positions selected from the group consisting of: 343, 348, and 354. In some embodiments, the engineered nuclease comprises substitutions at positions selected from the group consisting of: 343, 348, 354, and 348/354. In some embodiments, the engineered nuclease comprises one, two, or three substitutions selected from the group consisting of: N343R, A348R, and K354R. In some embodiments, the engineered nuclease comprises substitutions selected from the group consisting of: N343R, A348R, K354R, and A348R/K354R.

The engineered nuclease may comprise an amino acid sequence having at least 90% or at least 95% identity to SEQ ID NO: 112 with one, two, three, four, or five substitutions at positions selected from the group consisting of: 253, 357, 714, 719, and 725. In some embodiments, the engineered nuclease comprises substitutions at positions selected from the group consisting of: 253, 357, 714, 719, 725, 253/719, 253/725, 719/725, 253/719/725, and 253/725/357. In some embodiments, the engineered nuclease comprises one, two, three, four, or five substitutions selected from the group consisting of: E253R, N357A, Y714R, D719R, and N725R. In some embodiments, the engineered nuclease comprises substitutions selected from the group consisting of: E253R, N357A, Y714R, D719R, N725R, E253R/D719R, E253R/N725R, D719R/N725R, E253R/D719R/N725R, and E253R/N725R/N357A.

The engineered nuclease may comprise an amino acid sequence having at least 90% or at least 95% identity to SEQ ID NO: 293 with one, two, three, four, five, or six substitutions at positions selected from the group consisting of: 257, 362, 720, 725, 731, and 1057. In some embodiments, the engineered nuclease comprises substitutions at positions selected from the group consisting of: 257, 362, 720, 725, 731, 1057, 257/725, 257/731, 725/731, 257/725/731, 257/731/362, and 720/1057. In some embodiments, the engineered nuclease comprises one, two, three, four, five, or six substitutions selected from the group consisting of: E257R, N362A, N720R, G725R, T731R, and I1057L. In some embodiments, the engineered nuclease comprises substitutions selected from the group consisting of: E257R, N362A, N720R, G725R, T731R, I1057L, E257R/G725R, E257R/T731R, G725R/T731R, E257R/G725R/T731R, E257R/T731R/N362A, and N720R/I1057L.

The engineered nuclease may comprise: one or more of SEQ ID NOs: 1115-1120; one or more of SEQ ID NOs: 1121-1126; one or more of SEQ ID NOs: 1127-1132; one or more of SEQ ID NOs: 1133-1138; one or more of SEQ ID NOs: 1139-1144; one or more of SEQ ID NOs: 1145-1150; one or more of SEQ ID NOs: 1151-1156; one or more of SEQ ID NOs: 1157-1162; one or more of SEQ ID NOs: 1163-1168; one or more of SEQ ID NOs: 1169-1174; one or more of SEQ ID NOs: 1175-1180; one or more of SEQ ID NOs: 1181-1186; one or more of SEQ ID NOs: 1187-1192; one or more of SEQ ID NOs: 1193-1198; one or more of SEQ ID NOs: 1199-1204; one or more of SEQ ID NOs: 1205-1210; one or more of SEQ ID NOs: 1211-1216; one or more of SEQ ID NOs: 1217-1222; or one or more of SEQ ID NOs: 1219-1224.

In some embodiments, the engineered nuclease may comprise an amino acid sequence having at least 90% or at least 95% identity to SEQ ID NO: 29 and one or more of SEQ ID NOs: 1115-1120. In some embodiments, the engineered nuclease may comprise an amino acid sequence having at least 90% or at least 95% identity to SEQ ID NO: 333 and one or more of SEQ ID NOs: 1121-1126. In some embodiments, the engineered nuclease may comprise an amino acid sequence having at least 90% or at least 95% identity to SEQ ID NO: 347 and one or more of SEQ ID NOs: 1127-1132. In some embodiments, the engineered nuclease may comprise an amino acid sequence having at least 90% or at least 95% identity to SEQ ID NO: 351 and one or more of SEQ ID NOs: 1133-1138. In some embodiments, the engineered nuclease may comprise an amino acid sequence having at least 90% or at least 95% identity to SEQ ID NO: 73 and one or more of SEQ ID NOs: 1139-1144. In some embodiments, the engineered nuclease may comprise an amino acid sequence having at least 90% or at least 95% identity to SEQ ID NO: 77 and one or more of SEQ ID NOs: 1145-1150. In some embodiments, the engineered nuclease may comprise an amino acid sequence having at least 90% or at least 95% identity to SEQ ID NO: 432 and one or more of SEQ ID NOs: 1151-1156. In some embodiments, the engineered nuclease may comprise an amino acid sequence having at least 90% or at least 95% identity to SEQ ID NO: 434 and one or more of SEQ ID NOs: 1157-1162. In some embodiments, the engineered nuclease may comprise an amino acid sequence having at least 90% or at least 95% identity to SEQ ID NO: 327 and one or more of SEQ ID NOs: 1163-1168. In some embodiments, the engineered nuclease may comprise an amino acid sequence having at least 90% or at least 95% identity to SEQ ID NO: 416 and one or more of SEQ ID NOs: 1169-1174. In some embodiments, the engineered nuclease may comprise an amino acid sequence having at least 90% or at least 95% identity to SEQ ID NO: 420 and one or more of SEQ ID NOs: 1175-1180. In some embodiments, the engineered nuclease may comprise an amino acid sequence having at least 90% or at least 95% identity to SEQ ID NO: 341 and one or more of SEQ ID NOs: 1181-1186. In some embodiments, the engineered nuclease may comprise an amino acid sequence having at least 90% or at least 95% identity to SEQ ID NO: 15 and one or more of SEQ ID NOs: 1187-1192. In some embodiments, the engineered nuclease may comprise an amino acid sequence having at least 90% or at least 95% identity to SEQ ID NO: 65 and one or more of SEQ ID NOs: 1193-1198. In some embodiments, the engineered nuclease may comprise an amino acid sequence having at least 90% or at least 95% identity to SEQ ID NO: 414 and one or more of SEQ ID NOs: 1199-1204. In some embodiments, the engineered nuclease may comprise an amino acid sequence having at least 90% or at least 95% identity to SEQ ID NO: 77 and one or more of SEQ ID NOs: 1205-1210. In some embodiments, the engineered nuclease may comprise an amino acid sequence having at least 90% or at least 95% identity to SEQ ID NO: 461 and one or more of SEQ ID NOs: 1211-1216. In some embodiments, the engineered nuclease may comprise an amino acid sequence having at least 90% or at least 95% identity to SEQ ID NO: 380 and one or more of SEQ ID NOs: 1217-1222. In some embodiments, the engineered nuclease may comprise an amino acid sequence having at least 90% or at least 95% identity to SEQ ID NO: 383 and one or more of SEQ ID NOs: 1219-1224.

In some embodiments, the nuclease or engineered nuclease is covalently attached to a peptide or protein in a fusion protein.

In some embodiments, the peptide comprises a nuclear localization sequence (NLS). The nuclear localization sequence may be appended, for example, to the N-terminus, a C-terminus, or a combination thereof. In some embodiments, the nuclease comprises two or more NLSs. The two or more NLSs may be in tandem, separated by a linker, at either end terminus of the protein, or one or more may be embedded in the protein.

The nuclear localization sequence may comprise any amino acid sequence known in the art to functionally tag or direct a protein for import into a cell's nucleus (e.g., for nuclear transport). Usually, a nuclear localization sequence comprises one or more positively charged amino acids, such as lysine and arginine.

In some embodiments, the NLS is a monopartite sequence. A monopartite NLS comprise a single cluster of positively charged or basic amino acids. In some embodiments, the monopartite NLS comprises a sequence of K-K/R-X-K/R, wherein X can be any amino acid. Exemplary monopartite NLS sequences include those from the SV40 large T-antigen, c-Myc, and TUS-proteins. In select embodiments, the NLS sequence comprises the c-Myc NLS; PAAKRVKLD (SEQ ID NO: 1097).

In some embodiments, the NLS is a bipartite sequence. Bipartite NLSs comprise two clusters of basic amino acids, separated by a spacer of about 9-12 amino acids. Exemplary bipartite NLSs include the nuclear localization sequences of nucleoplasmin, EGL-12, or bipartite SV40. In select embodiments, the NLS comprises the NLS of nucleoplasmin, KR [PAATKKAGQA]KKKK (SEQ ID NO: 1098).

In some embodiments, the NLS comprises GRSSDDEATADSQHAAPPKKKRKV (SEQ ID NO: 1099).

The NLS may be appended to the nuclease by a linker. The linker may be a polypeptide of any amino acid sequence and length. The linker may act as a spacer peptide. In some embodiments, the linker is flexible. In some embodiments, the linker comprises at least one glycine and at least one serine. In some embodiments, the linker comprises an amino acid sequence consisting of $(Gly_2Ser)_n$, where n is the number of repeats comprising an integer from 2-20.

The peptide may comprise an epitope tag (e.g., 3×FLAG tag, an HA tag, a Myc tag, and the like). In some embodiments, the epitope tag may be adjacent, either upstream or downstream, to a nuclear localization sequence. The epitope tags may be at the N-terminus, a C-terminus, or a combination thereof of the corresponding protein.

The nuclease or engineered nuclease may be part of a fusion protein comprising another protein or protein domain.

For example, the nuclease or engineered nuclease may be fused to another protein or protein domain that provides for tagging or visualization (e.g., GFP). The nuclease or engineered nuclease may be fused to a protein or protein domain that has another functionality or activity useful to target to certain DNA sequences (e.g., nuclease activity such as that provide by FokI nuclease, protein modification activity such as histone modification activity including acetylation or deacetylation or demethylation or methyltransferase activity, transcription modulation activity such as activity of a transcriptional activator or repressor, base editing activity such as deaminase activity, DNA modifying activity such as DNA methylation activity, and the like).

In some embodiments, the nuclease or engineered nuclease may be fused with one or more (e.g., two, three, four, or more) protein transduction domains or PTDs, also known as a CPP-cell penetrating peptide. A protein transduction domains is a polypeptide, polynucleotide, carbohydrate, or organic or inorganic compound that facilitates traversing a lipid bilayer, micelle, cell membrane, organelle membrane, or vesicle membrane. A PTD attached to another molecule, facilitates the molecule traversing a membrane, for example going from extracellular space to intracellular space, or cytosol to within an organelle. In some embodiments, a PTD is covalently linked to a terminus of the nuclease or engineered nuclease (e.g., N-terminus, C-terminus, or both). In some embodiments, the PTD is inserted internally at a suitable insertion site. Examples of PTDs include but are not limited to a minimal undecapeptide protein transduction domain (corresponding to residues 47-57 of HIV-1 TAT comprising); a polyarginine sequence comprising a number of arginines sufficient to direct entry into a cell (e.g., 3, 4, 5, 6, 7, 8, 9, 10, or 10-50 arginines); a VP22 domain (Zender et al. (2002) *Cancer Gene Ther.* 9 (6): 489-96); a *Drosophila* Antennapedia protein transduction domain (Noguchi et al. (2003) *Diabetes* 52 (7): 1732-1737); a truncated human calcitonin peptide (Trehin et al. (2004) *Pharm. Research* 21:1248-1256); polylysine (Wender et al. (2000) *Proc. Natl. Acad. Sci. USA* 97:13003-13008); Transportan, and the like.

The nuclease or engineered nuclease may be fused via a linker polypeptide. The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers can be produced by using synthetic, linker-encoding oligonucleotides to couple the proteins, or can be encoded by a nucleic acid sequence encoding the fusion protein. Peptide linkers with a degree of flexibility can be used. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use, including but not limited to, glycine-serine polymers, glycine-alanine polymers, and alanine-serine polymers.

Compositions and Systems

Also disclosed herein are compositions comprising a nuclease or engineered nuclease as described herein or a nucleic acid molecule comprising a sequence encoding the nuclease or engineered nuclease. In some embodiments, the compositions further comprise at least one guide RNA (gRNA) or one or more nucleic acids comprising a sequence encoding the least one gRNA.

Further disclosed herein are systems for modifying a target nucleic acid comprising a nuclease as described herein (e.g., a nuclease comprising an amino acid sequence having at least 70% identity (e.g., at least 75%, at least 80%, at least 85%, at least 90%, at least 93%, at least 95%, at least 98%, at least 99% or 100% identity) to an amino acid sequence of SEQ ID NOs: 1-1096 or a nucleic acid molecule comprising a sequence encoding the nuclease.

In some embodiments, the components of the system may be in the form of a composition. In some embodiments, the components of the present compositions or systems may be mixed, individually or in any combination, with a carrier which are also within the scope of the present disclosure. Exemplary carriers include buffers, antioxidants, preservatives, carbohydrates, surfactants, and the like.

Also disclosed is a cell comprising the compositions or systems described herein. In some embodiments, the cell is a prokaryotic cell. In some embodiments, the cell is a eukaryotic cell. In some embodiments, the cell is a mammalian cell. In some embodiments, the cell is a human cell.

The compositions or systems disclosed herein may further comprise at least one gRNA complementary to at least a portion of a target nucleic acid sequence, or a nucleic acid encoding the at least one gRNA. In instances when the composition or system comprises more than one gRNA, each may be encoded on the same or different nucleic acid as the other gRNA.

The gRNA may be a crRNA, crRNA/tracrRNA (or single guide RNA, sgRNA). The terms "gRNA," "guide RNA," and "CRISPR guide sequence" may be used interchangeably throughout and refer to a nucleic acid comprising a sequence that determines the sequence specificity of the nuclease. A gRNA hybridizes to (complementary to, partially or completely) a target nucleic acid sequence (e.g., the genome in a host cell).

In some embodiments, the at least one gRNA is encoded in a CRISPR RNA (crRNA) array. CRISPR arrays contain a series of direct repeats separated by short sequences called spacers. The nucleases described herein may have a preference for direct repeat sequences. These can be determined by methods known in the art including those described in the Examples herein. For example, the CRISPR RNA (crRNA) may contain multiple gRNAs or may contain more than one different sequence each configured to hybridize a distinct target nucleic acid sequence.

The gRNA or portion thereof that hybridizes to the target nucleic acid (a target site) may be between 15-40 nucleotides in length. In some embodiments, the gRNA sequence that hybridizes to the target nucleic acid is 15, 16, 17, 18, 19, 20, 21, 22, 23, 24, 25, 26, 27, 28, 29, 30, 31, 32, 33, 34, 35, 36, 37, 38, 39, or 40 nucleotides in length. gRNAs or sgRNA(s) used in the present disclosure can be between about 5 and 100 nucleotides long, or longer (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 60, 61, 62, 63, 63, 64, 65, 66, 67, 68, 69, 70, 71, 72, 73, 74, 75, 76, 77, 78, 79, 80, 81, 82, 83, 84, 85, 86, 87, 88, 89, 90, 91 92, 93, 94, 95, 96, 97, 98, 99, or 100 nucleotides in length, or longer).

To facilitate gRNA design, many computational tools have been developed (See Prykhozhij et al. (PLOS ONE, 10 (3): (2015)); Zhu et al. (PLOS ONE, 9 (9) (2014)); Xiao et al. (Bioinformatics. Jan. 21, 2014); Heigwer et al. (Nat Methods, 11 (2): 122-123 (2014)). Methods and tools for guide RNA design are discussed by Zhu (Frontiers in Biology, 10 (4) pp 289-296 (2015)), which is incorporated by reference herein. Additionally, there are many publicly available software tools that can be used to facilitate the design of sgRNA(s); including but not limited to, Genscript Interactive CRISPR gRNA Design Tool, WU-CRISPR, and Broad Institute GPP sgRNA Designer. There are also publicly available pre-designed gRNA sequences to target many genes and locations within the genomes of many species (human, mouse, rat, zebrafish, C. elegans), including but not limited to, IDT DNA Predesigned Alt-R CRISPR-Cas9 guide RNAs, Addgene Validated gRNA Target Sequences, and GenScript Genome-wide gRNA databases.

In addition to a sequence that binds to a target nucleic acid, in some embodiments, the gRNA may also comprise a scaffold sequence (e.g., tracrRNA). In some embodiments, such a chimeric gRNA may be referred to as a single guide RNA (sgRNA). Exemplary scaffold sequences will be evident to one of skill in the art and can be found, for example, in Jinek, et al. Science (2012) 337 (6096): 816-821, and Ran, et al. Nature Protocols (2013) 8:2281-2308, incorporated herein by reference in their entireties.

In some embodiments, the gRNA sequence does not comprise a scaffold sequence and a scaffold sequence is expressed as a separate transcript. In such embodiments, the gRNA sequence further comprises an additional sequence that is complementary to a portion of the scaffold sequence and functions to bind (hybridize) the scaffold sequence.

In some embodiments, the gRNA sequence is at least 50%, 55%, 60%, 65%, 70%, 75%, 80%, 85%, 90%, 95%, 96%, 97%, 98%, 99%, or at least 100% complementary to a target nucleic acid. In some embodiments, the gRNA sequence is at least 50%, 55%, 60%, 65%, 70%, 75%, 80%, 85%, 90%, 95%, 96%, 97%, 98%, 99%, or at least 100% complementary to 3' end of the target nucleic acid (e.g., the last 5, 6, 7, 8, 9, or 10 nucleotides of 3' end of the target nucleic acid).

The gRNA may be a non-naturally occurring gRNA.

The target sequence may or may not be flanked by a protospacer adjacent motif (PAM) sequence. In certain embodiments, a nucleic acid-guided nuclease can only cleave a target sequence if an appropriate PAM is present, see, for example Doudna et al., Science, 2014, 346 (6213): 1258096, incorporated herein by reference. A PAM can be 5' or 3' of a target sequence. A PAM can be upstream or downstream of a target sequence. In one embodiment, the target sequence is immediately flanked on 3' end by a PAM sequence. A PAM can be 1, 2, 3, 4, 5, 6, 7, 8, 9, 10 or more nucleotides in length. In certain embodiments, a PAM is between 2-6 nucleotides in length. Sequence requirements for PAMs for any given nuclease can be determined using known methods, for example, the protocol of Walton et al. (Walton R T, et al., Science. 2020 Apr. 17; 368 (6488): 290-296, incorporated herein by reference in its entirety). In some embodiments, the engineered nucleases herein have an enlarged PAM preference, e.g., the engineered nuclease utilizes additional PAM sequences that are not used or are poorly used by a wildtype (non-engineered nuclease) or are not used or are poorly used by other nucleases such as a Cas12a (Cpf1) nuclease. In some embodiments, the engineered nucleases herein have a reduced PAM preference, e.g., the engineered nuclease utilizes fewer PAM sequences than are used by a wildtype (non-engineered nuclease) or by other nucleases such as a Cas12a (Cpf1) nuclease.

"Complementarity" refers to the ability of a nucleic acid to form hydrogen bond(s) with another nucleic acid sequence by either traditional Watson-Crick or other nontraditional types. A percent complementarity indicates the percentage of residues in a nucleic acid molecule, which can form hydrogen bonds (e.g., Watson-Crick base pairing) with a second nucleic acid sequence. Full complementarity is not necessarily required, provided there is sufficient complementarity to cause hybridization. There may be mismatches distal from the PAM.

In some cases, the compositions or systems disclosed herein may further comprise a donor polynucleotide. For example, in applications in which it is desirable to insert a polynucleotide sequence into the genome where a target sequence is cleaved, a donor polynucleotide (a nucleic acid comprising a donor sequence) can also be provided to the cell. By a "donor sequence" or "donor polynucleotide" or "donor template" it is meant a nucleic acid sequence to be inserted at the site targeted by the nuclease (e.g., after dsDNA cleavage, after nicking a target DNA, after dual nicking a target DNA, and the like). In some cases, the donor sequence is provided to the cell as single-stranded DNA. In some cases, the donor template is provided to the cell as double-stranded DNA. It may be introduced into a cell in linear or circular form. If introduced in linear form, the ends of the donor sequence may be protected (e.g., from exonucleolytic degradation) by any convenient method and such methods are known to those of skill in the art. For example, one or more dideoxynucleotide residues can be added to the 3' terminus of a linear molecule and/or self-complementary oligonucleotides can be ligated to one or both ends. A donor template can be introduced into a cell as part of a vector molecule having additional sequences such as, for example, replication origins, promoters and genes encoding antibiotic resistance. Moreover, donor template can be introduced as naked nucleic acid, as nucleic acid complexed with an agent such as a liposome or poloxamer, or can be delivered by viruses (e.g., adenovirus, AAV).

Also disclosed herein are one or more nucleic acids encoding the nucleases, the gRNA(s), and systems thereof. In some embodiments, the one or more nucleic acids comprise one or more messenger RNAs, one or more vectors, or any combination thereof. A single nucleic acid may encode the nuclease and the at least one gRNA, or the nuclease may be encoded on a separate nucleic acid from the at least one gRNA.

In some embodiments, the nuclease is provided as a split-nuclease (e.g., a nuclease can in some cases be delivered as a split-nuclease, or a nucleic acid(s) encoding a split-nuclease) such that two separate proteins together form a functional nuclease. In some such cases the sequences that encode the two parts of the split-nuclease protein are present on the same vector. In some cases, they are present on separate vectors, e.g., as part of a vector system that encodes the nucleases, the gRNA(s), and systems thereof.

In certain embodiments, engineering the nucleases for use in eukaryotic cells may involve codon-optimization. It will be appreciated that changing native codons to those most frequently used in mammals allows for maximum expression of the system proteins in mammalian cells (e.g., human cells). Such modified nucleic acid sequences are commonly described in the art as "codon-optimized," or as utilizing "mammalian-preferred" or "human-preferred" codons. In some embodiments, the nucleic acid sequence is considered codon-optimized if at least about 60% (e.g., 65%, 70%, 75%, 80%, 85%, 90%, 95%, or 98%) of the codons encoded therein are mammalian preferred codons.

The present disclosure also provides for DNA segments encoding the nucleases and nucleic acids (e.g., gRNA) disclosed herein, vectors containing these segments and cells containing the vectors. The vectors may be used to propagate the segment in an appropriate cell and/or to allow expression from the segment (e.g., an expression vector). The person of ordinary skill in the art would be aware of the various vectors available for propagation and expression of a nucleic acid sequence.

The present disclosure further provides engineered, non-naturally occurring vectors and vector systems, which can encode one or more or all of the components of the present system. The vector(s) can be introduced into a cell that is capable of expressing the polypeptide encoded thereby, including any suitable prokaryotic or eukaryotic cell.

The vectors of the present disclosure may be delivered to a eukaryotic cell in a subject. Modification of the eukaryotic cells via the present system can take place in a cell culture, where the method comprises isolating the eukaryotic cell from a subject prior to the modification. In some embodiments, the method further comprises returning said eukaryotic cell and/or cells derived therefrom to the subject.

Viral and non-viral based gene transfer methods can be used to introduce nucleic acids encoding components of the present system into cells, tissues, or a subject. Such methods can be used to administer nucleic acids encoding components of the present system to cells in culture, or in a host organism. Non-viral vector delivery systems include DNA plasmids, cosmids, RNA (e.g., a transcript of a vector described herein), a nucleic acid, and a nucleic acid complexed with a delivery vehicle. Viral vector delivery systems include DNA and RNA viruses, which have either episomal or integrated genomes after delivery to the cell. Viral vectors include, for example, retroviral, lentiviral, adenoviral, adeno-associated and herpes simplex viral vectors.

In certain embodiments, plasmids that are non-replicative, or plasmids that can be cured by high temperature may be used, such that any or all of the necessary components of the composition or system may be removed from the cells under certain conditions. For example. this may allow for DNA integration by transforming bacteria of interest, but then being left with engineered strains that have no memory of the plasmids or vectors used for the integration.

A variety of viral constructs may be used to deliver the present composition or system (such as a nuclease and one or more gRNA(s)) to the targeted cells and/or a subject. Nonlimiting examples of such recombinant viruses include recombinant adeno-associated virus (AAV), recombinant adenoviruses, recombinant lentiviruses, recombinant retroviruses, recombinant herpes simplex viruses, recombinant poxviruses, phages, etc. The present disclosure provides vectors capable of integration in the host genome, such as retrovirus or lentivirus. See, e.g., Ausubel et al., Current Protocols in Molecular Biology, John Wiley & Sons, New York, 1989; Kay, M. A., et al., 2001 Nat. Medic. 7 (1): 33-40; and Walther W. and Stein U., 2000 Drugs, 60 (2): 249-71, incorporated herein by reference.

In one embodiment, a DNA segment encoding the nuclease is contained in a plasmid vector that allows expression of the protein and subsequent isolation and purification of the protein produced by the recombinant vector. Accordingly, the nucleases disclosed herein can be purified following expression, obtained by chemical synthesis, or obtained by recombinant methods.

To construct cells that express the present system, expression vectors for stable or transient expression of the system, or any of its components, may be constructed via methods as described herein or known in the art and introduced into cells. For example, nucleic acids encoding the components of the present system may be cloned into a suitable expression vector, such as a plasmid or a viral vector in operable linkage to a suitable promoter. The selection of expression vectors/plasmids/viral vectors should be suitable for integration and replication in eukaryotic cells.

In certain embodiments, vectors of the present disclosure can drive the expression of one or more sequences in prokaryotic cells. Promoters that may be used include T7 RNA polymerase promoters, constitutive E. coli promoters, and promoters that could be broadly recognized by transcriptional machinery in a wide range of bacterial organisms. The composition or system may be used with various bacterial hosts.

In certain embodiments, vectors of the present disclosure can drive the expression of one or more sequences in mammalian cells using a mammalian expression vector. Examples of mammalian expression vectors include pCDM8 (Seed, Nature (1987) 329:840, incorporated herein by reference) and pMT2PC (Kaufman, et al., EMBO J. (1987) 6:187, incorporated herein by reference). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd eds., Cold Spring Harbor Laboratory, Cold Spring Harbor Laboratory Press, Cold Spring Harbor, N.Y., 1989, incorporated herein by reference.

Vectors of the present disclosure can comprise any of a number of promoters known to the art, wherein the promoter is constitutive, regulatable or inducible, cell type specific, tissue-specific, or species specific. In addition to the sequence sufficient to direct transcription, a promoter sequence of the invention can also include sequences of other regulatory elements that are involved in modulating transcription (e.g., enhancers, Kozak sequences and introns). Many promoter/regulatory sequences useful for driving constitutive expression of a gene are available in the art and include, but are not limited to, for example, CMV (cytomegalovirus promoter), EF1a (human elongation factor 1 alpha promoter), SV40 (simian vacuolating virus 40 promoter), PGK (mammalian phosphoglycerate kinase promoter), Ubc (human ubiquitin C promoter), human beta-actin promoter, rodent beta-actin promoter, CBh (chicken beta-actin promoter), CAG (hybrid promoter contains CMV enhancer, chicken beta actin promoter, and rabbit beta-globin splice acceptor), TRE (Tetracycline response element promoter), H1 (human polymerase III RNA promoter), U6 (human U6 small nuclear promoter), and the like. Additional promoters that can be used for expression of the components of the present system, include, without limitation, cytomegalovirus (CMV) intermediate early promoter, a viral LTR such as the Rous sarcoma virus LTR, HIV-LTR, HTLV-1 LTR, Maloney murine leukemia virus (MMLV) LTR, myeoloproliferative sarcoma virus (MPSV) LTR, spleen focus-forming virus (SFFV) LTR, the simian virus 40 (SV40) early promoter, herpes simplex tk virus promoter, elongation factor 1-alpha (EF1-α) promoter with or without the EF1-α intron. Additional promoters include any constitutively active promoter. Alternatively, any regulatable promoter may be used, such that its expression can be modulated within a cell. In embodiments, a polymerase II promoter is used to drive expression of the nuclease (e.g., a CMV promoter) and a polymerase III promoter (e.g., U6 promoter) is used to drive expression of the gRNA.

Different promoters and regulatory elements may be used to achieve proper balance (expression level ratio) between the components of the systems (e.g., the nuclease, the at least one gRNA). For example, in some cases a nucleic acid includes a promoters and regulatory elements that is operably linked to (and therefore regulates/modulates translation of) a sequence encoding the nuclease. In some cases, a subject nucleic acid includes a promoters and regulatory elements that is operably linked to a sequence encoding the gRNA. In some cases, the sequence encoding the nuclease and the sequence encoding the gRNA are both operably linked to the same promoters and regulatory elements.

A variety of promoter types are suitable for use. A promoter can be a constitutively active promoter (e.g., a promoter that is constitutively in an active/"ON" state), it may be an inducible promoter (e.g., a promoter whose state, active/"ON" or inactive/"OFF", is controlled by an external stimulus, e.g., the presence of a particular temperature, compound, or protein), it may be a spatially restricted promoter (e.g., tissue specific promoter, cell type specific promoter, etc.), and it may be a temporally restricted promoter (e.g., the promoter is in the "ON" state or "OFF" state during specific stages of embryonic development or during specific stages of a biological process, e.g., hair follicle cycle in mice).

Inducible and tissue specific expression of RNA or proteins can be accomplished by placing the nucleic acid encoding such a molecule under the control of an inducible or tissue specific promoter/regulatory sequence. The vectors of the present disclosure may direct expression of the nucleic acid in a particular cell type (e.g., tissue-specific regulatory elements are used to express the nucleic acid). Such regulatory elements include promoters that may be tissue specific or cell specific. The term "tissue specific" as it applies to a promoter refers to a promoter that is capable of directing selective expression of a nucleotide sequence of interest to a specific type of tissue (e.g., seeds) in the relative absence of expression of the same nucleotide sequence of interest in a different type of tissue. The term "cell type specific" as applied to a promoter refers to a promoter that is capable of directing selective expression of a nucleotide sequence of interest in a specific type of cell in the relative absence of expression of the same nucleotide sequence of interest in a different type of cell within the same tissue. The term "cell type specific" when applied to a promoter also means a promoter capable of promoting selective expression of a nucleotide sequence of interest in a region within a single tissue. Cell type specificity of a promoter may be assessed using methods well known in the art, e.g., immunohistochemical staining.

Examples of tissue specific or inducible promoter/regulatory sequences which are useful for this purpose include, but are not limited to, the rhodopsin promoter, the MMTV LTR inducible promoter, the SV40 late enhancer/promoter, synapsin 1 promoter, ET hepatocyte promoter, GS glutamine synthase promoter and many others. Various commercially available ubiquitous as well as tissue-specific promoters and tumor-specific are available, for example from InvivoGen. In addition, promoters that are well known in the art can be induced in response to inducing agents such as metals, glucocorticoids, tetracycline, hormones, and the like, are also contemplated for use with the invention. Thus, it will be appreciated that the present disclosure includes the use of any promoter/regulatory sequence known in the art that is capable of driving expression of the desired nuclease or RNA operably linked thereto.

Examples of spatially restricted promoters include, but are not limited to, neuron-specific promoters, adipocyte-specific promoters, cardiomyocyte-specific promoters, smooth muscle-specific promoters, photoreceptor-specific promoters, etc. Neuron-specific spatially restricted promoters include, but are not limited to, a neuron-specific enolase (NSE) promoter (see, e.g., EMBL HSENO2, X51956); an aromatic amino acid decarboxylase (AADC) promoter; a neurofilament promoter (see, e.g., GenBank HUMNFL, L04147); a synapsin promoter (see, e.g., GenBank HUMSYNIB, M55301); a thy-1 promoter; a serotonin receptor promoter (see, e.g., GenBank S62283); a tyrosine hydroxylase promoter (TH); a GnRH promoter; an L7 promoter; a DNMT promoter; an enkephalin; a myelin basic protein (MBP) promoter; a Ca2+-calmodulin-dependent protein kinase II-alpha (CamKIIa) promoter; a CMV enhancer/platelet-derived growth factor-promoter; and the like. Suitable liver-specific promoters can in some cases include, but are not limited to: TTR, Albumin, and AAT promoters. Suitable CNS-specific promoters can in some cases include, but are not limited to: Synapsin 1, BM88, CHNRB2, GFAP, and CAMK2a promoters. Suitable muscle-specific promoters can in some cases include, but are not limited to: MYOD1, MYLK2, SPc5-12 (synthetic), α-MHC, MLC-2, MCK, MHCK7, human cardiac troponin C (cTnC) and desmin promoters. Adipocyte-specific spatially restricted promoters include, but are not limited to, aP2 gene promoter/enhancer, e.g., a region from −5.4 kb to +21 bp of a human aP2; a glucose transporter-4 (GLUT4); a fatty acid translocase (FAT/CD36) promoter; a stearoyl-CoA desaturase-1 (SCD1) promoter; a leptin promoter; an adiponectin promoter; an adipsin promoter; a resistin promoter; and the like. Cardiomyocyte-specific spatially restricted promoters include, but are not limited to control sequences derived from the following genes: myosin light chain-2, α-myosin heavy chain, AE3, cardiac troponin C, cardiac actin, and the like. Smooth muscle-specific spatially restricted promoters include, but are not limited to, an SM22a promoter; a smoothelin promoter; an α-smooth muscle actin promoter; and the like. For example, a 0.4 kb region of the SM22α promoter, within which lie two CArG elements, has been shown to mediate vascular smooth muscle cell-specific. Photoreceptor-specific spatially restricted promoters include, but are not limited to, a rhodopsin promoter; a rhodopsin kinase promoter; a beta phosphodiesterase gene; a retinitis pigmentosa gene promoter; an interphotoreceptor retinoid-binding protein (IRBP) gene enhancer; an IRBP gene promoter; and the like.

Examples of inducible promoters include, but are not limited to, heat shock promoter, tetracycline-regulated promoter, steroid-regulated promoter, metal-regulated promoter, estrogen receptor-regulated promoter, etc. Inducible promoters can therefore be regulated by molecules including, but not limited to, doxycycline; an estrogen receptor; an estrogen receptor fusion; an estrogen analog; IPTG; and the like. Inducible promoters suitable for use include any inducible promoter described herein or known to one of ordinary skill in the art. Examples of inducible promoters include, without limitation, chemically/biochemically-regulated and physically-regulated promoters such as alcohol-regulated promoters, tetracycline-regulated promoters (e.g., anhydrotetracycline (aTc)-responsive promoters and other tetracycline-responsive promoter systems, which include a tetracycline repressor protein (tetR), a tetracycline operator sequence (tetO) and a tetracycline transactivator fusion protein (tTA)), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

Inducible promoters include sugar-inducible promoters (e.g., lactose-inducible promoters; arabinose-inducible promoters); amino acid-inducible promoters; alcohol-inducible promoters; and the like. Suitable promoters include, e.g., lactose-regulated systems (e.g., lactose operon systems, sugar-regulated systems, isopropyl-beta-D-thiogalactopyranoside (IPTG) inducible systems, arabinose regulated systems (e.g., arabinose operon systems, e.g., an ARA operon promoter, pBAD, PARA, portions thereof, combinations thereof and the like), synthetic amino acid regulated systems, fructose repressors, a tac promoter/operator (pTac), tryptophan promoters, PhoA promoters, recA promoters, proU promoters, cst-1 promoters, tetA promoters, cadA promoters, nar promoters, $P_L$ promoters, cspA promoters, and the like, or combinations thereof. In certain cases, a promoter comprises a Lac-Z, or portions thereof. In some cases, a promoter comprises a Lac operon, or portions thereof. In some cases, an inducible promoter comprises an ARA operon promoter, or portions thereof. In certain embodiments an inducible promoter comprises an arabinose promoter or portions thereof. An arabinose promoter can be obtained from any suitable bacteria. In some cases, an inducible promoter comprises an arabinose operon of E. coli or B. subtilis. In some cases, an inducible promoter is activated by the presence of a sugar or an analog thereof. Non-limiting examples of sugars and sugar analogs include lactose, arabinose (e.g., L-arabinose), glucose, sucrose, fructose, IPTG, and the like. Suitable promoters include a T7 promoter; a pBAD promoter; a lacIQ promoter; and the like. In some cases, the promoter is a J23119 promoter. Many bacterial promoters are known in the art; bacterial promoters can be found on the internet at parts(dot)igem(dot)org/promoters.

In some cases, the promoter is a reversible promoter. Suitable reversible promoters, including reversible inducible promoters are known in the art. Such reversible promoters may be isolated and derived from many organisms. Such reversible promoters may be isolated and derived from many organisms, e.g., eukaryotes and prokaryotes. Modification of reversible promoters derived from a first organism for use in a second organism is well known in the art. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR)), tetracycline regulated promoters, (e.g., promoter systems including TetActivators, TetON, TetOFF), steroid regulated promoters (e.g., rat glucocorticoid receptor promoter systems, human estrogen receptor promoter systems, retinoid promoter systems, thyroid promoter systems, ecdysone promoter systems, mifepristone promoter systems), metal regulated promoters (e.g., metallothionein promoter systems), pathogenesis-related regulated promoters (e.g., salicylic acid regulated promoters, ethylene regulated promoters, benzothiadiazole regulated promoters), temperature regulated promoters (e.g., heat shock inducible promoters (e.g., HSP-70, HSP-90, soybean heat shock promoter), light regulated promoters, synthetic inducible promoters, and the like.

Thus, it will be appreciated that the present disclosure includes the use of any promoter/regulatory sequence capable of driving expression of the desired nuclease or RNA operably linked thereto.

Additionally, the vector may contain, for example, some or all of the following: a selectable marker gene, such as the neomycin gene for selection of stable or transient transfectants in host cells; enhancer/promoter sequences from the immediate early gene of human CMV for high levels of transcription; transcription termination and RNA processing signals from SV40 for mRNA stability; 5'- and 3'-untranslated regions for mRNA stability and translation efficiency from highly-expressed genes like α-globin or β-globin; SV40 polyoma origins of replication and ColE1 for proper episomal replication; internal ribosome binding sites (IRESes), versatile multiple cloning sites; T7 and SP6 RNA promoters for in vitro transcription of sense and antisense RNA; a "suicide switch" or "suicide gene" which when triggered causes cells carrying the vector to die (e.g., HSV thymidine kinase, an inducible caspase such as iCasp9), and reporter gene for assessing expression of the chimeric receptor. Suitable vectors and methods for producing vectors containing transgenes are well known and available in the art. Selectable markers also include chloramphenicol resistance, tetracycline resistance, spectinomycin resistance, streptomycin resistance, erythromycin resistance, rifampicin resistance, bleomycin resistance, thermally adapted kanamycin resistance, gentamycin resistance, hygromycin resistance, trimethoprim resistance, dihydrofolate reductase (DHFR), GPT; the URA3, HIS4, LEU2, and TRP1 genes of *S. cerevisiae*.

When introduced into the cell, the vectors may be maintained as an autonomously replicating sequence or extrachromosomal element or may be integrated into host DNA.

The present composition and system (e.g., proteins, polynucleotides encoding these proteins, or compositions comprising the proteins and/or polynucleotides described herein) may be delivered by any suitable means. In certain embodiments, the composition or system is delivered in vivo. In other embodiments, the composition or system is delivered to isolated/cultured cells (e.g., autologous iPS cells) in vitro to provide modified cells useful for in vivo delivery to patients afflicted with a disease or condition.

Vectors according to the present disclosure can be transformed, transfected, or otherwise introduced into a wide variety of host cells. Transfection refers to the taking up of a vector by a host cell whether or not any coding sequences are in fact expressed. Numerous methods of transfection are known to the ordinarily skilled artisan, for example, lipofectamine, calcium phosphate co-precipitation, electroporation, DEAE-dextran treatment, microinjection, viral infection, and other methods known in the art. Transduction refers to entry of a virus into the cell and expression (e.g., transcription and/or translation) of sequences delivered by the viral vector genome. In the case of a recombinant vector, "transduction" generally refers to entry of the recombinant viral vector into the cell and expression of a nucleic acid of interest delivered by the vector genome.

Any of the vectors comprising a nucleic acid sequence that encodes the components of the present compositions and system is also within the scope of the present disclosure. Such a vector may be delivered into host cells by a suitable method. Methods of delivering vectors to cells are well known in the art and may include DNA or RNA electroporation, transfection reagents such as liposomes or nanoparticles to delivery DNA or RNA; delivery of DNA, RNA, or protein by mechanical deformation, or viral transduction. In some embodiments, the vectors are delivered to host cells by viral transduction. Nucleic acids can be delivered as part of a larger construct, such as a plasmid or viral vector, or directly, e.g., by electroporation, lipid vesicles, viral transporters, microinjection, and biolistics (high-speed particle bombardment). Similarly, the construct containing the one or more transgenes can be delivered by any method appropriate for introducing nucleic acids into a cell. Additionally, delivery vehicles such as nanoparticle- and lipid-based mRNA or protein delivery systems can be used. Further examples of delivery vehicles include lentiviral vectors, ribonucleoprotein (RNP) complexes, lipid-based delivery system, gene gun, hydrodynamic, electroporation or nucleofection microinjection, biolistics, and the like.

In some embodiments, the vector is a viral construct, e.g., a recombinant adeno-associated virus construct, a recombinant adenoviral construct, a recombinant lentiviral construct, a recombinant retroviral construct, etc. Suitable viral vectors include, but are not limited to, viral vectors based on vaccinia virus; poliovirus; adenovirus; adeno-associated virus; SV40; herpes simplex virus; human immunodeficiency virus; a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like.

In some embodiments, the vector is an AAV vector. By adeno-associated virus, or "AAV" it is meant the virus itself or derivatives thereof. The term covers all subtypes and both naturally occurring and recombinant forms, except where required otherwise, for example, AAV type 1 (AAV-1), AAV type 2 (AAV-2), AAV type 3 (AAV-3), AAV type 4 (AAV-4), AAV type 5 (AAV-5), AAV type 6 (AAV-6), AAV type 7 (AAV-7), AAV type 8 (AAV-8), AAV type 9 (AAV-9), AAV type 10 (AAV-10), AAV type 11 (AAV-11), avian AAV, bovine AAV, canine AAV, equine AAV, primate AAV, non-primate AAV, ovine AAV, a hybrid AAV (i.e., an AAV comprising a capsid protein of one AAV subtype and genomic material of another subtype), an AAV comprising a mutant AAV capsid protein or a chimeric AAV capsid (i.e. a capsid protein with regions or domains or individual amino acids that are derived from two or more different serotypes of AAV, e.g. AAV-DJ, AAV-LK3, AAV-LK19). "Primate AAV" refers to AAV that infect primates, "non-primate AAV" refers to AAV that infect non-primate mammals, "bovine AAV" refers to AAV that infect bovine mammals, etc.

By a "recombinant AAV vector" or "rAAV vector" it is meant an AAV virus or AAV viral chromosomal material comprising a polynucleotide sequence not of AAV origin (e.g., a polynucleotide heterologous to AAV), typically a nucleic acid sequence of interest to be integrated into the cell following the subject methods. In general, the heterologous polynucleotide is flanked by at least one, and generally by two AAV inverted terminal repeat sequences (ITRs). In some instances, the recombinant viral vector also comprises viral genes important for the packaging of the recombinant viral vector material. Packaging refers to the series of intracellular events that result in the assembly and encapsulation of a viral particle, e.g., an AAV viral particle. Examples of nucleic acid sequences important for AAV packaging include the AAV "rep" and "cap" genes, which encode for replication and encapsulation proteins of adeno-associated virus, respectively. The term rAAV vector encompasses both rAAV vector particles and rAAV vector plasmids.

A "viral particle" refers to a single unit of virus comprising a capsid encapsulating a virus-based polynucleotide, e.g., the viral genome (as in a wild-type virus), or, e.g., the subject targeting vector (as in a recombinant virus). An AAV viral particle refers to a viral particle composed of at least one AAV capsid protein (typically by all of the capsid proteins of a wild-type AAV) and an encapsulated polynucleotide AAV vector. If the particle comprises a heterologous polynucleotide (e.g., a polynucleotide other than a wild-type AAV genome, such as a transgene to be delivered to a mammalian cell), it is typically referred to as an "rAAV vector particle" or simply an "rAAV vector." Thus, production of rAAV particle necessarily includes production of rAAV vector, as such a vector is contained within an rAAV particle.

A rAAV virion can be constructed a variety of methods. For example, the heterologous sequence(s) can be directly inserted into an AAV genome which has had the major AAV open reading frames ("ORFs") excised therefrom. Other portions of the AAV genome can also be deleted, so long as a sufficient portion of the ITRs remain to allow for replication and packaging functions. In order to produce rAAV virions, an AAV expression vector can be introduced into a suitable host cell using known techniques, such as by transfection. Particularly suitable transfection methods include calcium phosphate co-, direct micro-injection into cultured cells, electroporation, liposome mediated gene transfer, lipid-mediated transduction, and nucleic acid delivery using high-velocity microprojectiles. Suitable cells for producing rAAV virions include microorganisms, yeast cells, insect cells, and mammalian cells, that can be, or have been, used as recipients of a heterologous DNA molecule.

An AAV virus that is produced may be replication competent or replication-incompetent. A "replication-competent" virus (e.g., a replication-competent AAV) refers to a phenotypically wild-type virus that is infectious and is also capable of being replicated in an infected cell (e.g., in the presence of a helper virus or helper virus functions). In the case of AAV, replication competence generally requires the presence of functional AAV packaging genes. In general, rAAV vectors as described herein are replication-incompetent in mammalian cells (especially in human cells) by virtue of the lack of one or more AAV packaging genes. Typically, such rAAV vectors lack any AAV packaging gene sequences in order to minimize the possibility that replication competent AAV are generated by recombination between AAV packaging genes and an incoming rAAV vector.

Retroviruses, for example, lentiviruses, are suitable for use in methods of the present disclosure. Commonly used retroviral vectors are unable to produce viral proteins required for productive infection. Rather, replication of the vector requires growth in a packaging cell line. To generate viral particles comprising nucleic acids of interest, the retroviral nucleic acids comprising the nucleic acid are packaged into viral capsids by a packaging cell line. Different packaging cell lines provide a different envelope protein (ecotropic, amphotropic or xenotropic) to be incorporated into the capsid, this envelope protein determining the specificity of the viral particle for the cells (ecotropic for murine and rat; amphotropic for most mammalian cell types including human, dog, and mouse; and xenotropic for most mammalian cell types except murine cells). The appropriate packaging cell line may be used to ensure that the cells are targeted by the packaged viral particles. Methods of introducing subject vector expression vectors into packaging cell lines and of collecting the viral particles that are generated by the packaging lines are well known in the art. Nucleic acids can also introduced by direct micro-injection (e.g., injection of RNA).

As noted elsewhere herein, proteins may instead be provided to cells as RNA (e.g., an RNA comprising the translational control element as discussed elsewhere herein). Methods of introducing RNA into cells may include, for example, direct injection, transfection, or any other method used for the introduction of DNA. The nuclease may also be introduced into a host cell directly as protein. In such instances, the nuclease may be delivered as an RNP (ribonucleoprotein complex) in which it is already complexed with an appropriate guide RNA.

The disclosed nucleic acids (e.g., vectors) and proteins can be delivered to cells using any convenient method. Suitable methods include, e.g., viral infection (e.g., AAV, adenovirus, lentiviral), transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery, and the like.

In some cases, a nuclease is delivered to a cell in a particle, or associated with a particle. In some cases, a nuclease is delivered with a cationic lipid and a hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol.

A nuclease may be delivered using particles or lipid envelopes. For example, a biodegradable core-shell structured nanoparticle with a poly (β-amino ester) (PBAE) core enveloped by a phospholipid bilayer shell can be used. In some cases, particles/nanoparticles based on self-assembling bioadhesive polymers are used; such particles/nanoparticles may be applied to oral delivery of peptides, intravenous delivery of peptides and nasal delivery of peptides, e.g., to the brain. Other embodiments, such as oral absorption and ocular delivery of hydrophobic drugs are also contemplated. A molecular envelope technology, which involves an engineered polymer envelope which is protected and delivered to the desired cell, can be used.

Lipidoid compounds (e.g., as described in U.S. Patent Application Publication No. 2011/0293703) are also useful in the delivery of polynucleotides, and can be used to deliver the disclosed nucleases (or RNA or DNA encoding thereof). In one aspect, the aminoalcohol lipidoid compounds are combined with an agent to be delivered to a cell to form microparticles, nanoparticles, liposomes, or micelles. The aminoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

A poly (beta-amino alcohol) (PBAA) can be used to deliver a nuclease, or a nucleic acid encoding thereof, and gRNA, or a nucleic acid encoding thereof, to a target cell. U.S. Patent Application Publication No. 2013/0302401 relates to a class of poly (beta-amino alcohols) (PBAAs) that has been prepared using combinatorial polymerization.

Sugar-based particles, for example GalNAc, as described in International Patent Publication No. WO2014118272 (incorporated herein by reference in its entirety and Nair, J K et al., 2014, Journal of the American Chemical Society 136 (49), 16958-16961) can be used to deliver a nuclease, or a nucleic acid encoding thereof, and gRNA, or a nucleic acid encoding thereof, to a target cell.

In some cases, lipid nanoparticles (LNPs) are used to deliver a nuclease, or a nucleic acid encoding thereof, and gRNA, or a nucleic acid encoding thereof, to a target cell. Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). Preparation of LNPs and is described in, e.g., Rosin et al. (2011) Molecular Therapy 19:1286-2200). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinKDMA), 1,2-dilinoleyl-4-(2-dimethylaminoethyl)-[1,3]-dioxolane (DLinKC2-DMA), (3-O-[2"-(methoxypolyethyleneglycol 2000) succinoyl]-1,2-dimyristoyl-sn-glycol (PEG-S-DMG), and R-3-[(.omega.-methoxy-poly (ethylene glycol) 2000) carbamoyl]-1,2-dimyristyloxlpropyl-3-amine (PEG-C-DOMG) may be used. A nucleic acid may be encapsulated in LNPs containing DLinDAP, DLinDMA, DLinK-DMA, and DLinKC2-DMA (cationic lipid:DSPC:CHOL:PEGS-DMG or PEG-C-DOMG at 40:10:40:10 molar ratios). In some cases, 0.2% SP-DiOC18 is incorporated.

Spherical Nucleic Acid (SNA™) constructs and other nanoparticles (particularly gold nanoparticles) can be used to deliver a nuclease, or a nucleic acid encoding thereof, and gRNA, or a nucleic acid encoding thereof, to a target cell.

Self-assembling nanoparticles with RNA may be constructed with polyethyleneimine (PEI) that is PEGylated with an Arg-Gly-Asp (RGD) peptide ligand attached at the distal end of the polyethylene glycol (PEG).

Nanoparticles suitable for use in delivering a nuclease, or a nucleic acid encoding thereof, and gRNA, or a nucleic acid encoding thereof, to a target cell may be provided in different forms, e.g., as solid nanoparticles (e.g., metal such as silver, gold, iron, titanium), non-metal, lipid-based solids, polymers), suspensions of nanoparticles, or combinations thereof. Metal, dielectric, and semiconductor nanoparticles may be prepared, as well as hybrid structures (e.g., core-shell nanoparticles). Nanoparticles made of semiconducting material may also be labeled quantum dots if they are small enough (typically below 10 nm) that quantization of electronic energy levels occurs. Such nanoscale particles are used in biomedical applications as drug carriers or imaging agents and may be adapted for similar purposes in the present disclosure. In general, a "nanoparticle" refers to any particle having a diameter of less than 1000 nm. In some cases, nanoparticles suitable for use in delivering a nuclease or nucleic acid to a target cell have a diameter of 500 nm or less, e.g., from 25 nm to 35 nm, from 35 nm to 50 nm, from 50 nm to 75 nm, from 75 nm to 100 nm, from 100 nm to 150 nm, from 150 nm to 200 nm, from 200 nm to 300 nm, from 300 nm to 400 nm, or from 400 nm to 500 nm. In some cases, nanoparticles suitable for use in delivering a nuclease or nucleic acid to a target cell have a diameter of from 25 nm to 200 nm.

In some cases, an exosome is used to deliver a nuclease, or a nucleic acid encoding thereof, and gRNA, or a nucleic acid encoding thereof, to a target cell. Exosomes are endogenous nano-vesicles that transport RNAs and proteins, and which can deliver RNA to the brain and other target organs.

In some cases, a liposome is used to deliver a nuclease, or a nucleic acid encoding thereof, and gRNA, or a nucleic acid encoding thereof, to a target cell. Liposomes are spherical vesicle structures composed of a uni- or multi-lamellar lipid bilayer surrounding internal aqueous compartments and a relatively impermeable outer lipophilic phospholipid bilayer. Liposomes can be made from several different types of lipids; however, phospholipids are most commonly used to generate liposomes. Although liposome formation is spontaneous when a lipid film is mixed with an aqueous solution, it can also be expedited by applying force in the form of shaking by using a homogenizer, sonicator, or an extrusion apparatus. Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside.

A stable nucleic-acid-lipid particle (SNALP) can be used to deliver a nuclease, or a nucleic acid encoding thereof, and gRNA, or a nucleic acid encoding thereof, to a target cell. The SNALP formulation may contain the lipids 3-N-[(methoxypoly (ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio. The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulting SNALP liposomes can be about 80-100 nm in size. A SNALP may comprise synthetic cholesterol (Sigma-Aldrich, St Louis, Mo., USA), dipalmitoylphosphatidylcholine (Avanti Polar Lipids, Alabaster, Ala., USA), 3-N-[(w-methoxy poly(ethylene glycol) 2000) carbamoyl]-1,2-dimyrestyloxypropylamine, and cationic 1,2-dilinoleyloxy-3-N,Ndimethylaminopropane. A SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N;N-dimethyl)aminopropane (DLinDMA).

Other cationic lipids, such as amino lipid 2,2-dilinoleyl-4-dimethylaminoethyl-[1,3]-dioxolane (DLin-KC2-DMA) can be used to deliver a nuclease or nucleic acid to a target cell. A preformed vesicle with the following lipid composition may be contemplated: amino lipid, distearoylphosphatidylcholine (DSPC), cholesterol and (R)-2,3-bis (octadecyloxy) propyl-1-(methoxy poly(ethylene glycol) 2000) propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11.+−.0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Lipids may be formulated with a nuclease, or a nucleic acid encoding thereof, and gRNA, or a nucleic acid encoding thereof, to form lipid nanoparticles (LNPs). Suitable lipids include, but are not limited to, DLin-KC2-DMA4, C12-200 and colipids disteroylphosphatidyl choline, cholesterol, and PEG-DMG may be formulated with a nuclease or nucleic acid using a spontaneous vesicle formation procedure.

A nuclease, or a nucleic acid encoding thereof, and gRNA, or a nucleic acid encoding thereof, may be delivered encapsulated in PLGA microspheres such as those further described in US published applications 20130252281, 20130245107, and 20130244279.

Supercharged proteins can be used to deliver a nuclease, or a nucleic acid encoding thereof, and gRNA, or a nucleic acid encoding thereof, to a target cell. Supercharged proteins are a class of engineered or naturally occurring proteins with unusually high positive or negative net theoretical charge. Both supernegatively and superpositively charged proteins exhibit the ability to withstand thermally or chemically induced aggregation. Superpositively charged proteins are also able to penetrate mammalian cells. Associating cargo with these proteins, such as plasmid DNA, RNA, or other proteins, can facilitate the functional delivery of these macromolecules into mammalian cells both in vitro and in vivo.

Cell Penetrating Peptides (CPPs) can be used to deliver a nuclease, or a nucleic acid encoding thereof, and gRNA, or a nucleic acid encoding thereof, to a target cell. CPPs typically have an amino acid composition that either contains a high relative abundance of positively charged amino acids such as lysine or arginine or has sequences that contain an alternating pattern of polar/charged amino acids and non-polar, hydrophobic amino acids.

Methods

The disclosure also provides methods of modifying a target nucleic acid sequence (e.g., DNA or RNA). The phrase "modifying a nucleic acid sequence," as used herein, refers to modifying at least one physical feature of a nucleic acid sequence of interest. Nucleic acid modifications include, for example, single or double strand breaks, deletion, or insertion of one or more nucleotides, and other modifications that affect the structural integrity or nucleotide sequence of the nucleic acid sequence. The modifications may comprise one or more of nucleic acid binding, base editing, transcription modulation, nucleic acid modification, protein modification, and histone modification.

The methods comprise contacting a target nucleic acid sequence with a composition as disclosed herein, a system disclosed herein or a composition comprising the system.

In one embodiment, the method introduces a single strand or double strand break in the target nucleic acid sequence. In this respect, the disclosed systems may direct cleavage of one or both strands of a target DNA sequence, such as within the target genomic DNA sequence and/or within the complement of the target sequence.

In some embodiments, modifying a DNA sequence comprises a deletion. The deletion may be upstream or downstream of the PAM binding side, so called unidirectional deletions. The deletion may encompass sequences on either side of the PAM binding site, a bidirectional deletion. The deletion of the DNA sequence may be of any size.

In some embodiments, contacting a target nucleic acid sequence comprises introducing the composition or system into the cell. As described above the composition or system may be introduced into eukaryotic or prokaryotic cells by methods known in the art.

The cell may be a prokaryotic cell, a plant cell, an insect cell, a vertebrate cell, an invertebrate cell, an animal cell, a mammalian cell, or a human cell. In some embodiments, the cell is a plant cell. In some embodiments, the cell is an insect cell. In some embodiments, the cell is a vertebrate cell. In some embodiments, the cell is an invertebrate cell. In some embodiments, the cell is a mammalian cell. In some embodiments, the cell is a human cell. In some cases, the cell is ex vivo (e.g., fresh isolate-early passage). In some cases, the cell is in vivo. In some cases, the cell is in culture in vitro (e.g., immortalized cell line).

Cells may be from established cell lines or they may be primary cells, where "primary cells," "primary cell lines," and "primary cultures" are used interchangeably herein to refer to cells and cells cultures that have been derived from a subject and allowed to grow in vitro for a limited number of passages of the culture. For example, primary cultures are cultures that may have been passaged 0 times, 1 time, 2 times, 4 times, 5 times, 10 times, or 15 times, but not enough times go through the crisis stage. Typically, the primary cell lines are maintained for fewer than 10 passages in culture.

Suitable cells include, but are not limited to: bacterial cell; an archaeal cell; a eukaryotic cell; a cell of a single-cell eukaryotic organism; a plant cell; a protozoa cell; an algal cell, e.g., *Botryococcus braunii, Chlamydomonas reinhardtii, Nannochloropsis gaditana, Chlorella pyrenoidosa, Sargassum patens, C. agardh*, and the like; a fungal cell (e.g., a yeast cell); an animal cell; a cell from an invertebrate animal (e.g. fruit fly, a cnidarian, an echinoderm, a nematode, etc.); a cell of an insect (e.g., a mosquito; a bee; an agricultural pest; etc.); a cell of an arachnid (e.g., a spider; a tick; etc.); a cell of a vertebrate animal (e.g., a fish, an amphibian, a reptile, a bird, a mammal); a cell of a mammal (e.g., a cell of a rodent; a cell of a human; a cell of a non-human mammal; a cell of a rodent (e.g., a mouse, a rat); a cell of a lagomorph (e.g., a rabbit); a cell of an ungulate (e.g., a cow, a horse, a camel, a llama, a vicuña, a sheep, a goat, etc.); a cell of a marine mammal (e.g., a whale, a seal, an elephant seal, a dolphin, a sea lion; etc.) and the like. Any type of cell may be of interest (e.g. a stem cell, e.g. an embryonic stem (ES) cell, an induced pluripotent stem (iPS) cell, a germ cell (e.g., an oocyte, a sperm, an oogonia, a spermatogonia, etc.), an adult stem cell, a somatic cell, e.g. a fibroblast, a hematopoietic cell, a neuron, a muscle cell, a bone cell, a hepatocyte, a pancreatic cell; an in vitro or in vivo embryonic cell of an embryo at any stage, e.g., a 1-cell, 2-cell, 4-cell, 8-cell, etc. stage zebrafish embryo; etc.). In some cases, the cell is a cell that does not originate from a natural organism (e.g., the cell can be a synthetically made cell; also referred to as an artificial cell).

Non-limiting examples of plant cell include cells from: plant crops, fruits, vegetables, grains, soybean, corn, maize, wheat, seeds, tomatoes, rice, cassava, sugarcane, pumpkin, hay, potatoes, cotton, cannabis, tobacco, flowering plants, conifers, gymnosperms, angiosperms, ferns, clubmosses, hornworts, liverworts, mosses, dicotyledons, monocotyledons, seaweeds (e.g., kelp), and the like.

Suitable cells include a stem cell (e.g., an embryonic stem (ES) cell, an induced pluripotent stem (iPS) cell; a germ cell (e.g., an oocyte, a sperm, an oogonia, a spermatogonia, etc.); a somatic cell, e.g., a fibroblast, an oligodendrocyte, a glial cell, a hematopoietic cell, a neuron, a muscle cell, a bone cell, a hepatocyte, a pancreatic cell, etc.

Suitable cells include human embryonic stem cells, fetal cardiomyocytes, myofibroblasts, mesenchymal stem cells, autotransplanted expanded cardiomyocytes, adipocytes, totipotent cells, pluripotent cells, blood stem cells, myoblasts, adult stem cells, bone marrow cells, mesenchymal cells, embryonic stem cells, parenchymal cells, epithelial cells, endothelial cells, mesothelial cells, fibroblasts, osteoblasts, chondrocytes, exogenous cells, endogenous cells, stem cells, hematopoietic stem cells, bone-marrow derived progenitor cells, myocardial cells, skeletal cells, fetal cells, undifferentiated cells, multi-potent progenitor cells, unipotent progenitor cells, monocytes, cardiac myoblasts, skeletal myoblasts, macrophages, capillary endothelial cells, xenogenic cells, allogenic cells, and post-natal stem cells.

In some cases, the cell is an immune cell, a neuron, an epithelial cell, and endothelial cell, or a stem cell. In some cases, the immune cell is a T cell, a B cell, a monocyte, a natural killer cell, a dendritic cell, or a macrophage. In some cases, the immune cell is a cytotoxic T cell. In some cases, the immune cell is a helper T cell. In some cases, the immune cell is a regulatory T cell (Treg).

In some cases, the cell is a stem cell. Stem cells include adult stem cells. Adult stem cells are also referred to as somatic stem cells.

Adult stem cells are resident in differentiated tissue but retain the properties of self-renewal and ability to give rise to multiple cell types, usually cell types typical of the tissue in which the stem cells are found. Numerous examples of somatic stem cells are known to those of skill in the art, including muscle stem cells; hematopoietic stem cells; epithelial stem cells; neural stem cells; mesenchymal stem cells; mammary stem cells; intestinal stem cells; mesodermal stem cells; endothelial stem cells; olfactory stem cells; neural crest stem cells; and the like.

Stem cells of interest include mammalian stem cells, where the term "mammalian" refers to any animal classified as a mammal, including humans; non-human primates; domestic and farm animals; and zoo, laboratory, sports, or pet animals, such as dogs, horses, cats, cows, mice, rats, rabbits, etc. In some cases, the stem cell is a human stem cell. In some cases, the stem cell is a rodent (e.g., a mouse; a rat) stem cell. In some cases, the stem cell is a non-human primate stem cell.

In some embodiments, the stem cell is a hematopoietic stem cell (HSC). HSCs are mesoderm-derived cells that can be isolated from bone marrow, blood, cord blood, fetal liver, and yolk sac. HSCs are characterized as $CD34^+$ and $CD3^-$. HSCs can repopulate the erythroid, neutrophil-macrophage, megakaryocyte, and lymphoid hematopoietic cell lineages in vivo. In vitro, HSCs can be induced to undergo at least some self-renewing cell divisions and can be induced to differentiate to the same lineages as is seen in vivo. As such, HSCs can be induced to differentiate into one or more of erythroid cells, megakaryocytes, neutrophils, macrophages, and lymphoid cells.

In other embodiments, the stem cell is a neural stem cell (NSC). Neural stem cells (NSCs) are capable of differentiating into neurons, and glia (including oligodendrocytes, and astrocytes). A neural stem cell is a multipotent stem cell which is capable of multiple divisions, and under specific conditions can produce daughter cells which are neural stem cells, or neural progenitor cells that can be neuroblasts or glioblasts, e.g., cells committed to become one or more types of neurons and glial cells, respectively. Methods of obtaining NSCs are known in the art.

In other embodiments, the stem cell is a mesenchymal stem cell (MSC). MSCs originally derived from the embryonal mesoderm and isolated from adult bone marrow, can differentiate to form muscle, bone, cartilage, fat, marrow stroma, and tendon. Methods of isolating MSC are known in the art; and any known method can be used to obtain MSC. See, e.g., U.S. Pat. No. 5,736,396, which describes isolation of human MSC.

In some embodiments, the cell is a T cell. The invention is not limited by the type of T cell. The T cells may be selected from, for example, CD3+ T cells, CD8+ T cells, CD4+ T cells, natural killer (NK) T cells, alpha beta T cells, gamma delta T cells, or any combination thereof (e.g., a combination of CD4+ and CD8+ T cells).

In some embodiments, the T cells are naturally occurring T cells. For example, the T cells may be isolated from a subject sample. In some embodiments, the T cell is an anti-tumor T cell (e.g., a T cell with activity against a tumor (e.g., an autologous tumor) that becomes activated and expands in response to antigen). Anti-tumor T cells include, but are not limited to, T cells obtained from resected tumors or tumor biopsies (e.g., tumor infiltrating lymphocytes (TILs)) and a polyclonal or monoclonal tumor-reactive T cell (e.g., obtained by apheresis, expanded ex vivo against tumor antigens presented by autologous or artificial antigen-presenting cells). In some embodiments, the T cells are expanded ex vivo.

A cell is in some cases a plant cell. A plant cell can be a cell of a monocotyledon. A plant cell can be a cell of a dicotyledon. The cells can be root cells, leaf cells, cells of the xylem, cells of the phloem, cells of the cambium, apical meristem cells, parenchyma cells, collenchyma cells, sclerenchyma cells, and the like. Plant cells include cells of agricultural crops such as wheat, corn, rice, sorghum, millet, soybean, etc. Plant cells include cells of agricultural fruit and nut plants, e.g., plant that produce apricots, oranges, lemons, apples, plums, pears, almonds, etc.

A plant cell can be a cell of a major agricultural plant, e.g., Barley, Beans (Dry Edible), Canola, Corn, Cotton (Pima), Cotton (Upland), Flaxseed, Hay (Alfalfa), Hay (Non-Alfalfa), Oats, Peanuts, Rice, Sorghum, Soybeans, Sugarbeets, Sugarcane, Sunflowers (Oil), Sunflowers (Non-Oil), Sweet Potatoes, Tobacco (Burley), Tobacco (Flue-cured), Tomatoes, Wheat (Durum), Wheat (Spring), Wheat (Winter), and the like. As another example, the cell is a cell of a vegetable crops which include but are not limited to, e.g., alfalfa sprouts, aloe leaves, arrow root, arrowhead, artichokes, asparagus, bamboo shoots, banana flowers, bean sprouts, beans, beet tops, beets, bittermelon, bok choy, broccoli, broccoli rabe (*rappini*), brussels sprouts, cabbage, cabbage sprouts, cactus leaf (nopales), calabaza, cardoon, carrots, cauliflower, celery, chayote, chinese artichoke (crosnes), chinese cabbage, chinese celery, chinese chives, choy sum, *chrysanthemum* leaves (tung ho), collard greens, corn stalks, corn-sweet, cucumbers, daikon, dandelion greens, dasheen, dau mue (pea tips), donqua (winter melon), eggplant, endive, escarole, fiddle head ferns, field cress, frisee, gai choy (chinese mustard), gailon, galanga (siam, thai ginger), garlic, ginger root, gobo, greens, hanover salad greens, huauzontle, jerusalem artichokes, jicama, kale greens, kohlrabi, lamb's quarters (quilete), lettuce (bibb), lettuce (boston), lettuce (boston red), lettuce (green leaf), lettuce (iceberg), lettuce (lolla rossa), lettuce (oak leaf-green), lettuce (oak leaf-red), lettuce (processed), lettuce (red leaf), lettuce (romaine), lettuce (ruby romaine), lettuce (russian red mustard), linkok, lo bok, long beans, lotus root, mache, maguey (agave) leaves, malanga, mesculin mix, mizuna, moap (smooth luffa), moo, moqua (fuzzy squash), mushrooms, mustard, nagaimo, okra, ong choy, onions green, opo (long squash), ornamental corn, ornamental gourds, parsley, parsnips, peas, peppers (bell type), peppers, pumpkins, radicchio, radish sprouts, radishes, rape greens, rape greens, rhubarb, romaine (baby red), rutabagas, salicornia (sea bean), sinqua (angled/ridged luffa), spinach, squash, straw bales, sugarcane, sweet potatoes, swiss chard, tamarindo, taro, taro leaf, taro shoots, tatsoi, tepeguaje (guaje), tindora, tomatillos, tomatoes, tomatoes (cherry), tomatoes (grape type), tomatoes (plum type), tumeric, turnip tops greens, turnips, water chestnuts, yampi, yams (names), yu choy, yuca (cassava), and the like.

A cell is in some cases an arthropod cell. For example, the cell can be a cell of a sub-order, a family, a sub-family, a group, a sub-group, or a species of, e.g., *chelicerata, myriapodia, hexipodia, arachnida, insecta, archaeognatha, thysanura, palaeoptera, ephemeroptera, odonata, anisoptera, zygoptera, neoptera, exopterygota, plecoptera, embioptera, orthoptera, zoraptera, dermaptera, dictyoptera, notoptera, grylloblattidae, mantophasmatidae, phasmatodea, blattaria, isoptera, mantodea, parapneuroptera, psocoptera, thysanoptera, phthiraptera, hemiptera, endopterygota* or *holometabola, hymenoptera, coleoptera, strepsiptera, raphidioptera, megaloptera, neuroptera, mecoptera, siphonaptera, diptera, trichoptera,* or *lepidoptera*.

A cell is in some cases an insect cell. For example, in some cases, the cell is a cell of a mosquito, a grasshopper, a true bug, a fly, a flea, a bee, a wasp, an ant, a louse, a moth, or a beetle.

In some embodiments, introducing the system into a cell comprises administering the system to a subject. In some embodiments, the subject is human. The administering may comprise in vivo administration. In alternative embodiments, a vector is contacted with a cell in vitro or ex vivo and the treated cell, containing the system, is transplanted into a subject.

In some embodiments, the target nucleic acid is a nucleic acid endogenous to a target cell. In some embodiments, the target nucleic acid is a genomic DNA sequence. The term "genomic," as used herein, refers to a nucleic acid sequence (e.g., a gene or locus) that is located on a chromosome in a cell.

In some embodiments, the target nucleic acid encodes a gene or gene product. The term "gene product," as used herein, refers to any biochemical product resulting from expression of a gene. Gene products may be RNA or protein. RNA gene products include non-coding RNA, such as tRNA, rRNA, micro RNA (miRNA), and small interfering RNA (siRNA), and coding RNA, such as messenger RNA (mRNA). In some embodiments, the target nucleic acid sequence encodes a protein or polypeptide.

The disclosed method may modify a target DNA sequence in a cell so as to modulate expression of the target DNA sequence, e.g., expression of the target DNA sequence is increased, decreased, or completely eliminated (e.g., via deletion of a gene). In one embodiment, the disclosed system cleaves a target DNA sequence of the host cell to produce double strand DNA breaks. The double strand breaks can be repaired by the host cell by either non-homologous end joining (NHEJ) or homologous recombination. In NHEJ, the double-strand breaks are repaired by direct ligation of the break ends to one another. In homologous recombination repair, a donor nucleic acid molecule comprising a second DNA sequence with homology to the cleaved target DNA sequence is used as a template for repair of the cleaved target DNA sequence, resulting in the transfer of genetic information from the donor nucleic acid molecule to the target DNA. As a result, new nucleic acid material is inserted/copied into the DNA break site. The modifications of the target sequence due to NHEJ and/or homologous recombination repair may lead to, for example, gene correction, gene replacement, gene tagging, transgene insertion, nucleotide deletion, gene disruption, gene mutation, gene knock-down, etc.

In some embodiments, the systems and methods described herein may be used to correct one or more defects or mutations in a gene (referred to as "gene correction"). In such cases, the target sequence encodes a defective version of a gene, and the disclosed compositions and systems further comprise a donor nucleic acid molecule which encodes a wild-type or corrected version of the gene.

In another embodiment, the method of modifying a target sequence can be used to delete nucleic acids from a target sequence in a host cell by cleaving the target sequence and allowing the host cell to repair the cleaved sequence in the absence of an exogenously provided donor nucleic acid molecule. Deletion of a nucleic acid sequence in this manner can be used in a variety of applications, such as, for example, to remove disease-causing trinucleotide repeat sequences in neurons, to create gene knock-outs or knock-downs, and to generate mutations for disease models in research.

In some embodiments, the systems and methods described herein may be used to insert a gene or fragment thereof into a cell. In particular embodiments, the disclosed systems may be used to generate a cell that expresses a recombinant receptor. In some embodiments, the recombinant receptor is a T cell receptor (TCR) or a chimeric antigen receptor (CAR). Also provided herein are cells, e.g., a T cell, comprising a recombinant receptor and/or a nucleic acid encoding thereof and a system (e.g., nuclease and at least one gRNA) as described herein.

In some embodiments, the system and methods described herein may be used to genetically modify a plant or plant cell. As used herein, genetically modified plants include a plant into which has been introduced an exogenous polynucleotide. Genetically modified plants also include a plant that has been genetically manipulated such that endogenous nucleotides have been altered to include a mutation, such as a deletion, an insertion, a transition, a transversion, or a combination thereof. For instance, an endogenous coding region could be deleted. Such mutations may result in a polypeptide having a different amino acid sequence than was encoded by the endogenous polynucleotide. Another example of a genetically modified plant is one having an altered regulatory sequence, such as a promoter, to result in increased or decreased expression of an operably linked endogenous coding region. The genetically modified plant may promote a desired phenotypic or genotypic plant trait.

Genetically modified plants can potentially have improved crop yields, enhanced nutritional value, and increased shelf life. They can also be resistant to unfavorable environmental conditions, insects, and pesticides. The present systems and methods have broad applications in gene discovery and validation, mutational and cisgenic breeding, and hybrid breeding. The present systems and methods may facilitate the production of a new generation of genetically modified crops with various improved agronomic traits such as herbicide resistance, herbicide tolerance, drought tolerance, male sterility, insect resistance, abiotic stress tolerance, modified fatty acid metabolism, modified carbohydrate metabolism, modified seed yield, modified oil percent, modified protein percent, resistance to bacterial disease, disease (e.g. bacterial, fungal, and viral) resistance, high yield, and superior quality. The present systems and methods may also facilitate the production of a new generation of genetically modified crops with optimized fragrance, nutritional value, shelf-life, pigmentations (e.g., lycopene content), starch content (e.g., low-gluten wheat), toxin levels, propagation and/or breeding and growth time. See, for example, CRISPR/Cas Genome Editing and Precision Plant Breeding in Agriculture (Chen et al., Annu Rev Plant Biol. 2019 Apr. 29; 70:667-69), incorporated herein by reference.

The present system and method may confer one or more of the following traits to the plant cell: herbicide tolerance, drought tolerance, male sterility, insect resistance, abiotic stress tolerance, modified fatty acid metabolism, modified carbohydrate metabolism, modified seed yield, modified oil percent, modified protein percent, resistance to bacterial disease, resistance to fungal disease, and resistance to viral disease.

The present disclosure provides for a modified plant cell produced by the present system and method, a plant comprising the plant cell, and a seed, fruit, plant part, or propagation material of the plant. Transformed or genetically modified plant cells of the present disclosure may be as populations of cells, or as a tissue, seed, whole plant, stem, fruit, leaf, root, flower, stem, tuber, grain, animal feed, a field of plants, and the like. The present disclosure provides a transgenic plant. The transgenic plant may be homozygous or heterozygous for the genetic modification. Also provided by the present disclosure are transformed or genetically modified plant cells, tissues, plants, and products that contain the transformed or genetically modified plant cells. The present disclosure further encompasses the progeny, clones, cell lines or cells of the transgenic plants.

The present system and method may be used to modify a plant stem cell. The present disclosure further provides progeny of a genetically modified cell, where the progeny can comprise the same genetic modification as the genetically modified cell from which it was derived. The present disclosure further provides a composition comprising a genetically modified cell.

In one embodiment, the transformed or genetically modified cells, and tissues and products comprise a nucleic acid integrated into the genome, and production by plant cells of a gene product due to the transformation or genetic modification.

Methods of introducing exogenous nucleic acids into plant cells are well known in the art. Such plant cells are considered "transformed." DNA constructs can be introduced into plant cells by various methods, including, but not limited to PEG- or electroporation-mediated protoplast transformation, tissue culture or plant tissue transformation by biolistic bombardment, or the *Agrobacterium*-mediated transient and stable transformation. The transformation can be transient or stable transformation. Suitable methods also include viral infection (such as double stranded DNA viruses), transfection, conjugation, protoplast fusion, electroporation, particle gun technology, calcium phosphate precipitation, direct microinjection, silicon carbide whiskers technology, *Agrobacterium*-mediated transformation, and the like. The choice of method is generally dependent on the type of cell being transformed and the circumstances under which the transformation is taking place (i.e., in vitro, ex vivo, or in vivo). Transformation methods based upon the soil bacterium *Agrobacterium tumefaciens* are useful for introducing an exogenous nucleic acid molecule into a vascular plant. The wild-type form of *Agrobacterium* contains a Ti (tumor-inducing) plasmid that directs production of tumorigenic crown gall growth on host plants. Transfer of the tumor-inducing T-DNA region of the Ti plasmid to a plant genome requires the Ti plasmid-encoded virulence genes as well as T-DNA borders, which are a set of direct DNA repeats that delineate the region to be transferred. An *Agrobacterium*-based vector is a modified form of a Ti plasmid, in which the tumor inducing functions are replaced by the nucleic acid sequence of interest to be introduced into the plant host.

*Agrobacterium*-mediated transformation generally employs cointegrate vectors or binary vector systems, in which the components of the Ti plasmid are divided between a helper vector, which resides permanently in the *Agrobacterium* host and carries the virulence genes, and a shuttle vector, which contains the gene of interest bounded by T-DNA sequences. A variety of binary vectors are well known in the art and are commercially available, for example, from Clontech (Palo Alto, Calif.). Methods of coculturing *Agrobacterium* with cultured plant cells or wounded tissue such as leaf tissue, root explants, hypocotyledons, stem pieces or tubers, for example, also are well known in the art. See, e.g., Glick and Thompson, (eds.), Methods in Plant Molecular Biology and Biotechnology, Boca Raton, Fla.: CRC Press (1993), incorporated herein by reference.

Microprojectile-mediated transformation also can be used to produce a transgenic plant. This method, first described by Klein et al. (Nature 327:70-73 (1987), incorporated herein by reference), relies on microprojectiles such as gold or tungsten that are coated with the desired nucleic acid molecule by precipitation with calcium chloride, spermidine, or polyethylene glycol. The microprojectile particles are accelerated at high speed into an angiosperm tissue using a device such as the BIOLISTIC PD-1000 (Biorad; Hercules Calif.).

In one embodiment, the present systems and methods may be adapted to use in plants. In one embodiment, a series of plant-specific RNA-guided Genome Editing vectors (pRGE plasmids) are provided for expression of the present system in plants. The vectors may be optimized for transient expression of the present system in plant protoplasts, or for stable integration and expression in intact plants via the *Agrobacterium*-mediated transformation. In one aspect, the vector constructs include a nucleotide sequence comprising a DNA-dependent RNA polymerase III promoter, wherein the promoter is operably linked to a gRNA molecule and a Pol III terminator sequence, and a nucleotide sequence comprising a DNA-dependent RNA polymerase II promoter operably linked to a nucleic acid sequence encoding the nuclease.

In certain embodiments, the present systems and methods use a monocot promoter to drive the expression of one or more components of the present systems (e.g., gRNA) in a monocot plant. In certain embodiments, the present systems and methods use a dicot promoter to drive the expression of one or more components of the present systems (e.g., gRNA) in a dicot plant. In some embodiments, the present system is transiently expressed in plant protoplasts. Vectors for transient transformation of plants include, but are not limited to, pRGE3, pRGE6, pRGE31, and pRGE32. In some embodiment, the vector may be optimized for use in a particular plant type or species, such as pStGE3.

In one embodiment, the present system may be stably integrated into the plant genome, for example via *Agrobacterium*-mediated transformation. Thereafter, one or more components of the present system (e.g., the transgene) may be removed by genetic cross and segregation, which may lead to the production of non-transgenic, but genetically modified plants or crops. In one embodiment, the vector is optimized for *Agrobacterium*-mediated transformation. In one embodiment, the vector for stable integration is pRGEB3, pRGEB6, pRGEB31, pRGEB32, or pStGEB3.

The present system may be used in various bacterial hosts, including human pathogens that are medically important, and bacterial pests that are key targets within the agricultural industry, as well as antibiotic resistant versions thereof.

The system and method may be designed to target any gene or any set of genes, such as virulence or metabolic genes, for clinical and industrial applications in other embodiments. For example, the present systems and methods may be used to target and eliminate virulence genes from the population, to perform in situ gene knockouts, or to stably introduce new genetic elements to the metagenomic pool of a microbiome. The present systems and methods may be used to treat a multi-drug resistance bacterial infection in a subject. The present systems and methods may be used for genomic engineering within complex bacterial consortia.

The present systems and methods may be used to inactivate microbial genes. In some embodiments, the gene is an antibiotic resistance gene. For example, the coding sequence of bacterial resistance genes may be disrupted in vivo by insertion of a DNA sequence, leading to non-selective re-sensitization to drug treatment.

In some embodiments, introducing the system into a cell comprises administering the system to a subject. In some embodiments, the subject is human. The administering may comprise in vivo administration. In alternative embodiments, a vector is contacted with a cell in vitro or ex vivo and the treated cell, containing the system, is transplanted into a subject.

The components of the composition, system or ex vivo treated cells may be administered to a cell or subject with a pharmaceutically acceptable carrier or excipient as a pharmaceutical composition. In some embodiments, the components of the present system may be mixed, individually or in any combination, with a pharmaceutically acceptable carrier to form pharmaceutical compositions, which are also within the scope of the present disclosure.

The methods described here also provide for treating a disease or condition in a subject. The method may comprise administering to the subject, in vivo, or by transplantation of ex vivo treated cells (e.g., disclosed T cells), a therapeutically effective amount of the present system, or components thereof. A "subject" or "patient" may be human or non-human and may include, for example, animal strains or species used as "model systems" for research purposes, such a mouse model as described herein.

In some embodiments, the systems and methods are used to treat a pathogen or parasite on or in a subject by altering the pathogen or parasite. In some embodiments, the systems and methods target a "disease-associated" gene. The term "disease-associated gene," refers to any gene or polynucleotide whose gene products are expressed at an abnormal level or in an abnormal form in cells obtained from a disease-affected individual as compared with tissues or cells obtained from an individual not affected by the disease. A disease-associated gene may be expressed at an abnormally high level or at an abnormally low level, where the altered expression correlates with the occurrence and/or progression of the disease. A disease-associated gene also refers to a gene, the mutation or genetic variation of which is directly responsible or is in linkage disequilibrium with a gene(s) that is responsible for the etiology of a disease. Examples of genes responsible for such "single gene" or "monogenic" diseases include, but are not limited to, adenosine deaminase, α-1 antitrypsin, cystic fibrosis transmembrane conductance regulator (CFTR), β-hemoglobin (HBB), oculocutaneous albinism II (OCA2), Huntingtin (HTT), dystrophia myotonica-protein kinase (DMPK), low-density lipoprotein receptor (LDLR), apolipoprotein B (APOB), neurofibromin 1 (NF1), polycystic kidney disease 1 (PKD1), polycystic kidney disease 2 (PKD2), coagulation factor VIII (F8), dystrophin (DMD), phosphate-regulating endopeptidase homologue, X-linked (PHEX), methyl-CpG-binding protein 2 (MECP2), and ubiquitin-specific peptidase 9Y, Y-linked (USP9Y). Other single gene or monogenic diseases are known in the art and described in, e.g., Chial, H. *Rare Genetic Disorders: Learning About Genetic Disease Through Gene Mapping, SNPs, and Microarray Data, Nature Education* 1 (1): 192 (2008); Online Mendelian Inheritance in Man (OMIM); and the Human Gene Mutation Database (HGMD). In another embodiment, the target genomic DNA sequence can comprise a gene, the mutation of which contributes to a particular disease in combination with mutations in other genes. Diseases caused by the contribution of multiple genes which lack simple (i.e., Mendelian) inheritance patterns are referred to in the art as a "multifactorial" or "polygenic" disease. Examples of multifactorial or polygenic diseases include, but are not limited to, asthma, diabetes, epilepsy, hypertension, bipolar disorder, and schizophrenia. Certain developmental abnormalities also can be inherited in a multifactorial or polygenic pattern and include, for example, cleft lip/palate, congenital heart defects, and neural tube defects. In another embodiment, the target DNA sequence can comprise a cancer oncogene.

The present disclosure provides for gene editing methods that can ablate a disease-associated gene (e.g., a cancer oncogene), which in turn can be used for in vivo gene therapy for patients. In some embodiments, the gene editing methods include donor nucleic acids comprising therapeutic genes.

In some embodiments, an effective amount of the components of the present system or compositions as described herein can be administered. Within the context of the present disclosure, the term "effective amount" refers to that quantity of the components of the system such that modification of the target nucleic acid is achieved.

When utilized as a method of treatment, the effective amount may depend on the particular condition being treated, the severity of the condition, the individual patient parameters including age, physical condition, size, gender and weight, the duration of the treatment, the nature of concurrent therapy (if any), the specific route of administration and like factors within the knowledge and expertise of the health practitioner. In some embodiments, the effective amount alleviates, relieves, ameliorates, improves, reduces the symptoms, or delays the progression of any disease or disorder in the subject. In some embodiments, the subject is a human.

A wide range of additional therapies may be used in conjunction with the methods of the present disclosure. The additional therapy may be administration of an additional therapeutic agent or may be an additional therapy not connected to administration of another agent. Such additional therapies include, but are not limited to, surgery, immunotherapy, radiotherapy. The additional therapy may be administered at the same time as the above methods. In some embodiments, the additional therapy may precede or follow the treatment of the disclosed methods by time intervals ranging from hours to months.

In some embodiments, a therapeutically effective amount of a system (e.g., nuclease and/or gRNA) or compositions described herein, is administered alone or in combination with a therapeutically effective amount of at least one additional therapeutic agent. In some embodiments, effective combination therapy is achieved with a single composition or pharmacological formulation or with two distinct compositions or formulations, administered at the same time or separated by a time interval. The at least one additional therapeutic agent may comprise any manner of therapeutic, including protein, small molecule, nucleic acids, and the like. For example, exemplary additional therapeutic agents include, but are not limited to, immune modulators, chemotherapeutic agents, a nucleic acid (e.g., mRNA, aptamers, antisense oligonucleotides, ribozyme nucleic acids, interfering RNAs, antigene nucleic acids), decongestants, steroids, analgesics, antimicrobial agents, immunotherapies, or any combination thereof.

In the context of the present disclosure insofar as it relates to any of the disease conditions recited herein, the terms "treat," "treatment," and the like mean to relieve or alleviate at least one symptom associated with such condition, or to slow or reverse the progression of such condition. Within the meaning of the present disclosure, the term "treat" also denotes to arrest, delay the onset (e.g., the period prior to clinical manifestation of a disease) and/or reduce the risk of developing or worsening a disease. For example, in connection with cancer the term "treat" may mean eliminate or reduce a patient's tumor burden, or prevent, delay, or inhibit metastasis, etc.

The phrase "pharmaceutically acceptable," as used in connection with compositions and/or cells of the present disclosure, refers to molecular entities and other ingredients of such compositions that are physiologically tolerable and do not typically produce untoward reactions when administered to a subject (e.g., a mammal, a human). Preferably, as used herein, the term "pharmaceutically acceptable" means approved by a regulatory agency of the Federal or a state government or listed in the U.S. Pharmacopeia or other generally recognized pharmacopeia for use in mammals, and more particularly in humans. "Acceptable" means that the carrier is compatible with the active ingredient of the composition (e.g., the nucleic acids, vectors, cells, or therapeutic antibodies) and does not negatively affect the subject to which the composition(s) are administered. Any of the pharmaceutical compositions and/or cells to be used in the present methods can comprise pharmaceutically acceptable carriers, excipients, or stabilizers in the form of lyophilized formations or aqueous solutions.

Pharmaceutically acceptable carriers, including buffers, are well known in the art, and may comprise phosphate, citrate, and other organic acids; antioxidants including ascorbic acid and methionine; preservatives; low molecular weight polypeptides; proteins, such as serum albumin, gelatin, or immunoglobulins; amino acids; hydrophobic polymers; monosaccharides; disaccharides; and other carbohydrates; metal complexes; and/or non-ionic surfactants. See, e.g., Remington: The Science and Practice of Pharmacy 20th Ed. (2000) Lippincott Williams and Wilkins, Ed. K. E. Hoover.

In some cases, desirable delivery systems provide for roughly uniform distribution and have controllable rates of release of their components (e.g., vectors, proteins, nucleic acids) in vivo. A variety of different media are described below that are useful in creating composition delivery systems. It is not intended that any one medium is limiting to the present invention. Note that any medium may be combined with another medium or carrier; for example, in one embodiment a polymer microparticle attached to a compound may be combined with a gel medium. An implantable device can be used to deliver a nuclease, or a nucleic acid encoding thereof, and gRNA, or a nucleic acid encoding thereof, to, for example, a target cell in vivo.

Carriers or mediums contemplated include materials such as gelatin, collagen, cellulose esters, dextran sulfate, pentosan polysulfate, chitin, saccharides, albumin, fibrin sealants, synthetic polyvinyl pyrrolidone, polyethylene oxide, polypropylene oxide, block polymers of polyethylene oxide and polypropylene oxide, polyethylene glycol, acrylates, acrylamides, methacrylates including, but not limited to, 2-hydroxyethyl methacrylate, poly(ortho esters), cyanoacrylates, gelatin-resorcin-aldehyde type bioadhesives, polyacrylic acid and copolymers and block copolymers thereof.

In some cases, a carrier/medium can include a microparticle. Microparticles can include, but are not limited to, liposomes, nanoparticles, microspheres, nanospheres, microcapsules, and nanocapsules. In some cases, microparticle can include one or more of the following: a poly (lactide-co-glycolide), aliphatic polyesters including, but not limited to, poly-glycolic acid and poly-lactic acid, hyaluronic acid, modified polysaccharides, chitosan, cellulose, dextran, polyurethanes, polyacrylic acids, pseudo-poly (amino acids), polyhydroxybutyrate-related copolymers, polyanhydrides, polymethylmethacrylate, poly (ethylene oxide), lecithin and phospholipids—in any combination thereof.

In some cases, a carrier/medium can include a liposome that is capable of attaching and releasing therapeutic agents (e.g., the subject nucleic acids and/or proteins). Liposomes are microscopic spherical lipid bilayers surrounding an aqueous core that are made from amphiphilic molecules such as phospholipids. For example, a liposome may trap a therapeutic agent between the hydrophobic tails of the phospholipid micelle. Water soluble agents can be entrapped in the core and lipid-soluble agents can be dissolved in the shell-like bilayer. Liposomes have a special characteristic in that they enable water soluble and water insoluble chemicals to be used together in a medium without the use of surfactants or other emulsifiers. Liposomes can form spontaneously by forcefully mixing phospholipids in aqueous media. Water soluble compounds are dissolved in an aqueous solution capable of hydrating phospholipids. Upon formation of the liposomes, therefore, these compounds are trapped within the aqueous liposomal center. The liposome wall, being a phospholipid membrane, holds fat soluble materials such as oils. Liposomes provide controlled release of incorporated compounds. In addition, liposomes can be coated with water soluble polymers, such as polyethylene glycol to increase the pharmacokinetic half-life.

In some embodiments, a cationic or anionic liposome is used as part of a subject composition or method, or liposomes having neutral lipids can also be used. Cationic liposomes can include negatively-charged materials by mixing the materials and fatty acid liposomal components and allowing them to charge-associate. The choice of a cationic or anionic liposome depends upon the desired pH of the final liposome mixture.

Any element of any suitable CRISPR/Cas gene editing system known in the art can be employed in the systems and methods described herein, as appropriate. CRISPR/Cas gene editing technology is described in detail in, for example, U.S. Pat. Nos. 8,546,553; 8,697,359; 8,771,945; 8,795,965;

8,865,406; 8,871,445; 8,889,356; 8,889,418; 8,895,308; 8,9066,616; 8,932,814; 8,945,839; 8,993,233; 8,999,641; 9,115,348; 9,149,049; 9,493,844; 9,567,603; 9,637,739; 9,663,782; 9,404,098; 9,885,026; 9,951,342; 10,087,431; 10,227,610; 10,266,850; 10,601,748; 10,604,771; and 10,760,064; and U.S. Patent Application Publication Nos. US2010/0076057; US2014/0113376; US2015/0050699; US2015/0031134; US2014/0357530; US2014/0349400; US2014/0315985; US2014/0310830; US2014/0310828; US2014/0309487; US2014/0294773; US2014/0287938; US2014/0273230; US2014/0242699; US2014/0242664; US2014/0212869; US2014/0201857; US2014/0199767; US2014/0189896; US2014/0186919; US2014/0186843; and US2014/0179770, each incorporated herein by reference.

Kits

Also within the scope of the present disclosure are kits that include the compositions, systems, or components thereof as disclosed herein.

For example the kits may contain one or more reagents or other components useful, necessary, or sufficient for practicing any of the methods described herein, such as, editing reagents (nuclease, guide RNAs, vectors, compositions, etc.), transfection or administration reagents, negative and positive control samples (e.g., cells, template DNA), cells, containers housing one or more components (e.g., microcentrifuge tubes, boxes), detectable labels, detection and analysis instruments, software, instructions, and the like.

The kit may include instructions for use in any of the methods described herein. The instructions can comprise a description of administration of the present system or composition to a subject to achieve the intended effect. The instructions generally include information as to dosage, dosing schedule, and route of administration for the intended treatment. The kit may further comprise a description of selecting a subject suitable for treatment based on identifying whether the subject is in need of the treatment.

The kits provided herein are in suitable packaging. Suitable packaging includes, but is not limited to, vials, bottles, jars, flexible packaging, and the like. A kit may have a sterile access port (for example, the container may be an intravenous solution bag or a vial having a stopper pierceable by a hypodermic injection needle). The container may also have a sterile access port.

The packaging may be unit doses, bulk packages (e.g., multi-dose packages) or sub-unit doses. Instructions supplied in the kits of the disclosure are typically written instructions on a label or package insert. The label or package insert indicates that the pharmaceutical compositions are used for treating, delaying the onset, and/or alleviating a disease or disorder in a subject.

Kits optionally may provide additional components such as buffers and interpretive information. Normally, the kit comprises a container and a label or package insert(s) on or associated with the container. In some embodiment, the disclosure provides articles of manufacture comprising contents of the kits described above.

The kit may further comprise a device for holding or administering the present system or composition. The device may include an infusion device, an intravenous solution bag, a hypodermic needle, a vial, and/or a syringe.

The kit will typically be provided with its various components in one or more packages, e.g., a fiber-based, a cardboard, polymeric, or a Styrofoam box. The enclosure(s) can be configured so as to maintain a temperature differential between the interior and the exterior, for example, to provide insulating properties to keep the reagents at a preselected temperature for a preselected time. The packaging can be air-tight, waterproof (e.g., impermeable to changes in moisture or evaporation), and/or light-tight.

EXAMPLES

The following are examples of the present invention and are not to be construed as limiting.

Example 1

Nuclease and Guide RNA Vectors

Nuclease expression vectors Codon-optimized genes encoding exemplary nucleases (nuclease amino acid sequences SEQ ID NOs: 1-7) were synthesized and cloned into a mammalian expression vector under the CMV promoter (FIG. 1). As indicated below in Table 1, a subset of the nucleases included a nucleoplasmin Nuclear Localization Sequence (NLS) on their C-terminal, while other nucleases included an OPT NLS followed by the linker provided in Table 1. All were followed by a 3×HA tag.

TABLE 1

|  | Sequence | SEQ ID NO: | On C-terminal of nucleases by SEQ ID NO: |
|---|---|---|---|
| Nucleoplasmin NLS | KRPAATKKAGQAKK KK | 1098 | 1, 2, 3, 4, 5 |
| OPT NLS | GRSSDDEATADSQH AAPPKKKRKV | 1099 | 6, 7 |
| Linker | GGSGGSGGSGGSGG SGGSGGSGGSLEGS | 1100 | 6, 7 |
| 3x HA tag | YPYDVPDYAYPYDV PDYAYPYDVPDYA | 1101 | All | crRNA/guide vectors To make specific guide vectors for each nuclease, direct repeat (DR) sequences were placed downstream of the U6 promoter with either a starting G or starting A (Table 2). For editing to occur via the nucleases, a spacer target sequence is placed downstream of the DR sequence; the sequences for FANCF1 and DNMT1 targets are shown in Table 3. An example of a nuclease expression vector and guide vector are shown in FIG. 1.

TABLE 2

| Direct Repeat | Sequence | SEQ ID NO: |
|---|---|---|
| DR12s | AATTTCTACTATCGTAGAT | 1102 |
| DR12L | GTTTAATAAGAATACATAA TTTCTACTATCGTAGAT | 1103 |
| DR16s | AATTTCTACTATTGTAGAT | 1104 |
| DR21s | AATTTCTACTGTTGTAGAT | 1105 |
| DR51s | AATTTCTACTATGTGTAGA T | 1106 |

TABLE 3

| Target | Sequence | SEQ ID NO: | PAM |
|---|---|---|---|
| FANCF1 | GGCGGGGTCCAGTTCCGGGA | 1107 | TTTG |
| DNMT1 | CTGATGGTCCATGTCTGTTA | 1108 | TTTC |

Example 2

Editing Activity in Human Cells

Nucleases were tested for activity in HEK293T cells following plasmid transfection using Mirus Transit X2 reagent. Using the vectors constructed in Example 1, tests were performed in 96 well plates transfected with 150 ng of nuclease expression vector and 50 ng of targeting guide vector following the Mirus Transit X2 transfection recommendations. Samples were incubated for 72h and harvested with Quick Extract (Lucigen). Genomic DNA was amplified using genomic region-specific primers (Table 4). Samples were checked on a 2% agarose gel for purity, cleaned up and sequenced by Sanger sequencing. TIDE analysis was performed following the method of Brinkman et al., (Brinkman E K, Chen T, Amendola M, van Steensel B. Nucleic Acids Res. 2014; 42 (22): e168, incorporated herein by reference in its entirety) and recommendations at tide(dot)nki(dot)nl. TIDE output data on editing efficiency was plotted using Prism software. The list of targets used to validate the nucleases is provided in Table 3.

TABLE 4

| Target | Forward primer | SEQ ID NO: | Reverse primer | SEQ ID NO: |
|---|---|---|---|---|
| DNMT1-3 | CCAGAATGCACAAAGTACTGCAC | 1109 | GCCAAAGCCCGAGAGAGTGCC | 1110 |
| FANCF-1 | GGAGACGTTCATGACTGGCA | 1111 | CGCCTGGGTCTTCATCAGAG | 1112 |

Figure 2:
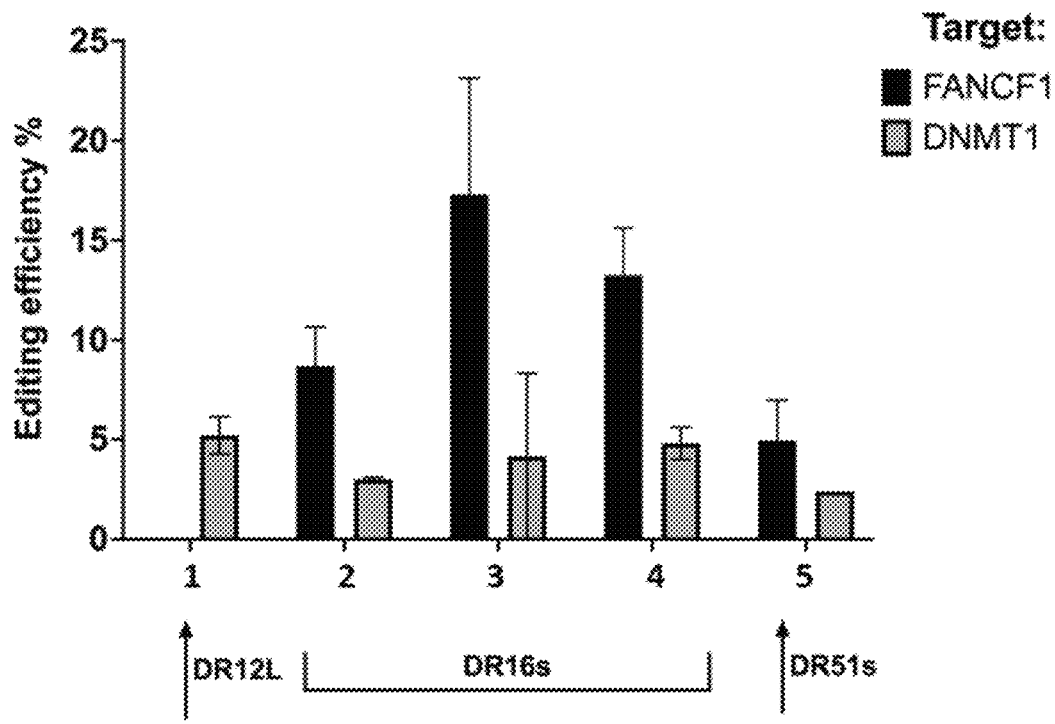
FIG. 2 is a graph of editing activity for exemplary nucleases (SEQ ID NOs: 1-5) in human cells.

Editing data for nucleases (SEQ ID NOs: 1, 2, 3, 4, and 5) is shown in FIG. 2. FANCF1 and DNMT1 were targeted with guide vectors containing the direct repeats (DRs) as indicated on the graph for each nuclease. Background variation in Sanger sequencing trace from untransfected cells is subtracted from all editing efficiency values.

Example 3

Editing Comparison with Various Direct Repeats (DRs)

Figure 3:
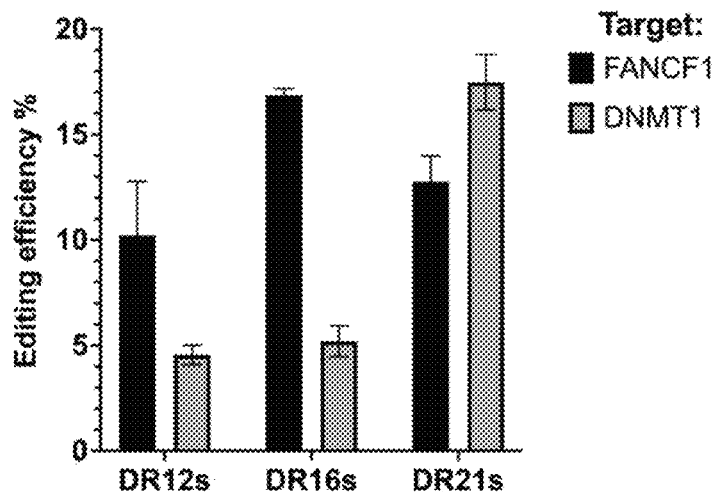
FIG. 3 is a graph of comparative editing efficiencies for an exemplary nuclease (SEQ ID NO: 2) transfected with different direct repeats (DRs).

To explore the guide preferences of exemplary nuclease of SEQ ID NO: 2, the nuclease was transfected with different DRs (see Example 1, Table 2) targeting either FANCF1 or DNMT1 using the methods in Example 2. Although the nuclease was able to edit both targets with any DR tested, each DR showed a different editing profile between the two targets (FIG. 3).

Example 4

Guide Multiplexing

Figure 4:
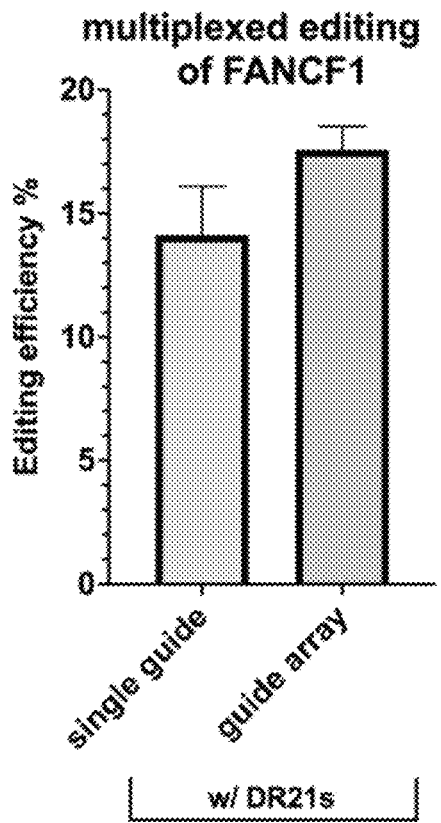
FIG. 4 is a graph of editing efficiencies for an exemplary nuclease (SEQ ID NO: 2) using single or multiple guide RNAs on a single transcript.

To test the multiplexing abilities (e.g., multiple guides on a single RNA transcript) of exemplary nuclease of SEQ ID NO: 2, a multiplexing guide vector was modified from the single guide vectors described in Example 1. The multiplexing guide vector contained four different targets (FANCF1, DNMT1, SMN CR3L, and GRIN2B). Targets were separated by DR21s to allow the nuclease to process the long RNA transcript into smaller guides, complex with the guides, and edit the target sites. The same methods as in Example 2 were used, except with 100 ng of the nuclease expression vector being co-transfected with 50 ng of the single or multiplexing guide vector. As shown in FIG. 4, the nuclease is able to efficiently edit FANCF1 when the target is included in a multiplexed guide array.

Example 5

Engineered Nucleases

Two nucleases (SEQ ID NOs: 2 and 3) were each engineered to contain 3 point mutations as shown in Table 4 and the NLS was switched from a nucleoplasmin NLS to an OPT NLS with linker (see Example 1, Table 1).

TABLE 4

| Original Nux | Mutations | Engineered Nux |
|---|---|---|
| SEQ ID NO: 2 | D141R, D484R, K490R | SEQ ID NO: 6 |
| SEQ ID NO: 3 | E158R, G546R, K552R | SEQ ID NO: 7 |

Figure 5:
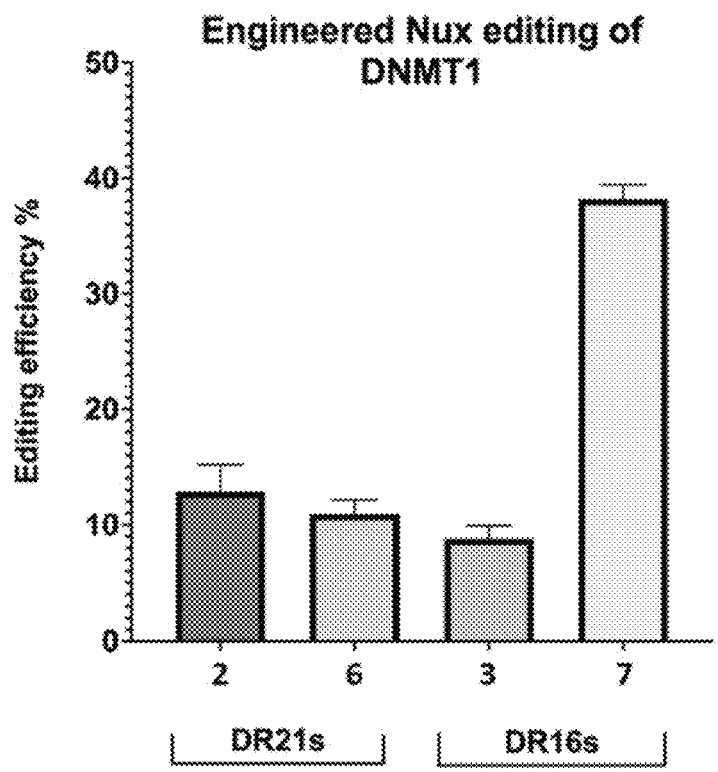
FIG. 5 is a graph of two exemplary nucleases (SEQ ID NOs: 2 and 3) and triple point mutants (SEQ ID NOs: 6 and 7) of the two exemplary nucleases.

The editing efficiency of the nucleases (SEQ ID NOs: 2 and 3) and their engineered forms (SEQ ID NOs: 6 and 7, respectively) was assessed on DNMT1 as shown in FIG. 5. Transfection methods were the same as in Example 2. As shown in FIG. 5, the changes in SEQ ID NO: 3 to create SEQ ID NO: 7 increased the editing efficiency. However, the changes to SEQ ID NO: 2 to SEQ ID NO: 6 did not result in an increase in editing efficiency.

Example 6

PAM Sequence Preferences

Figure 6A:
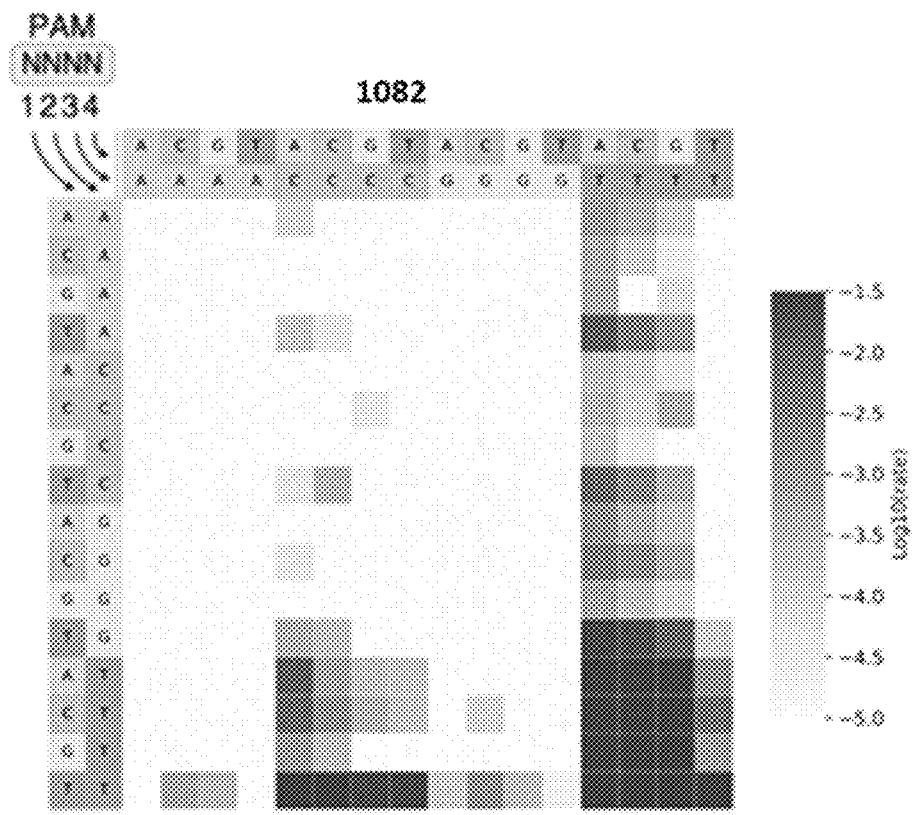
FIGS. 6A-C are heatmaps for nuclease editing efficiencies, for the indicated nucleases identified by SEQ ID NO, as a function of PAM sequences.
Figure 6B:
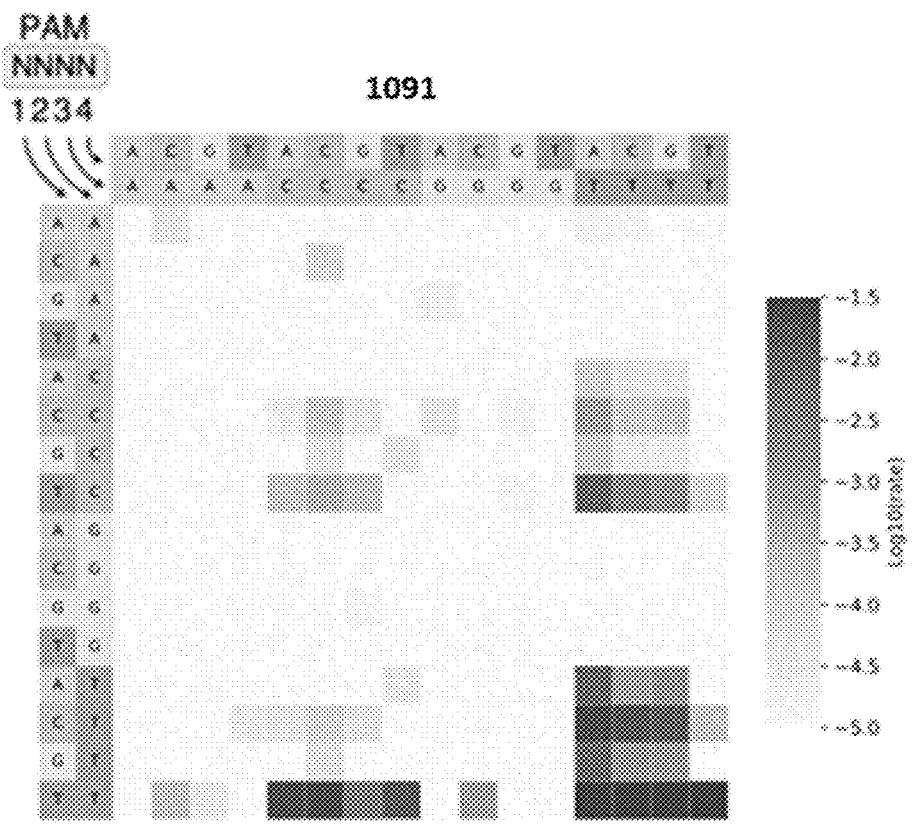
Figure 6B:
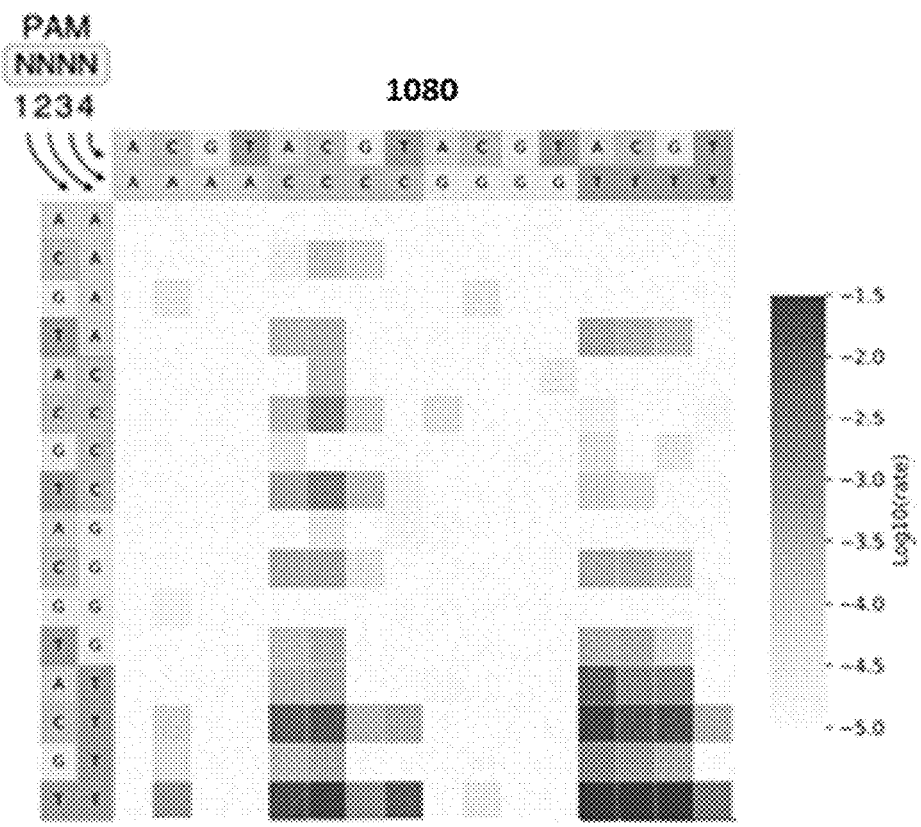
Figure 6C:
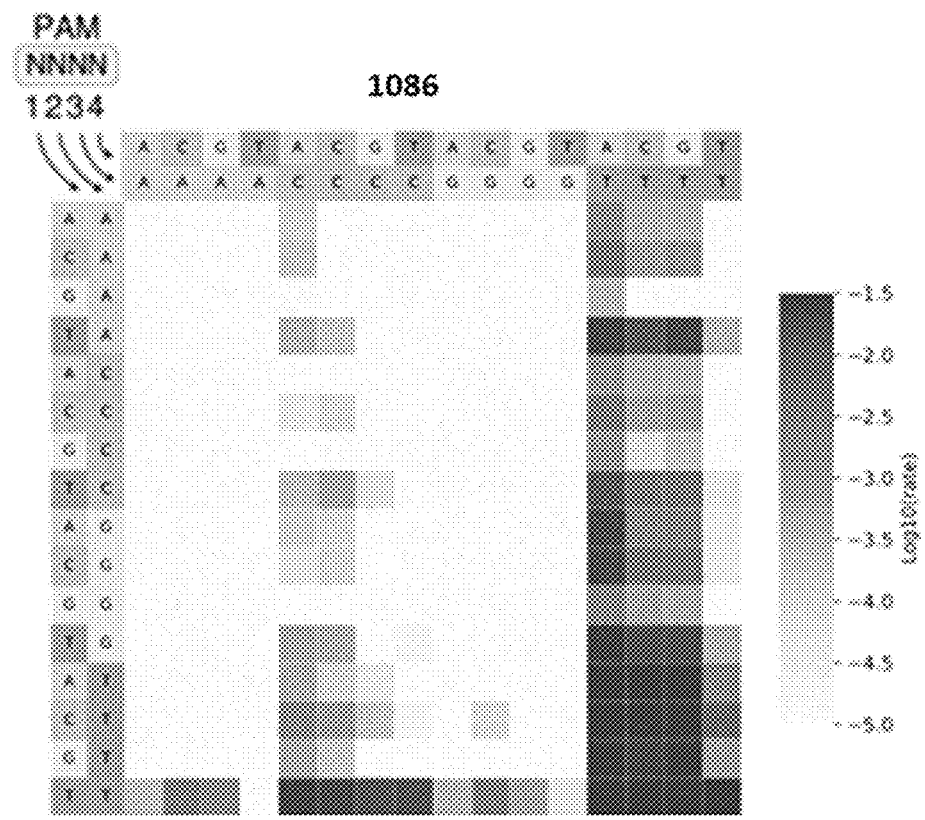
Figure 6C:
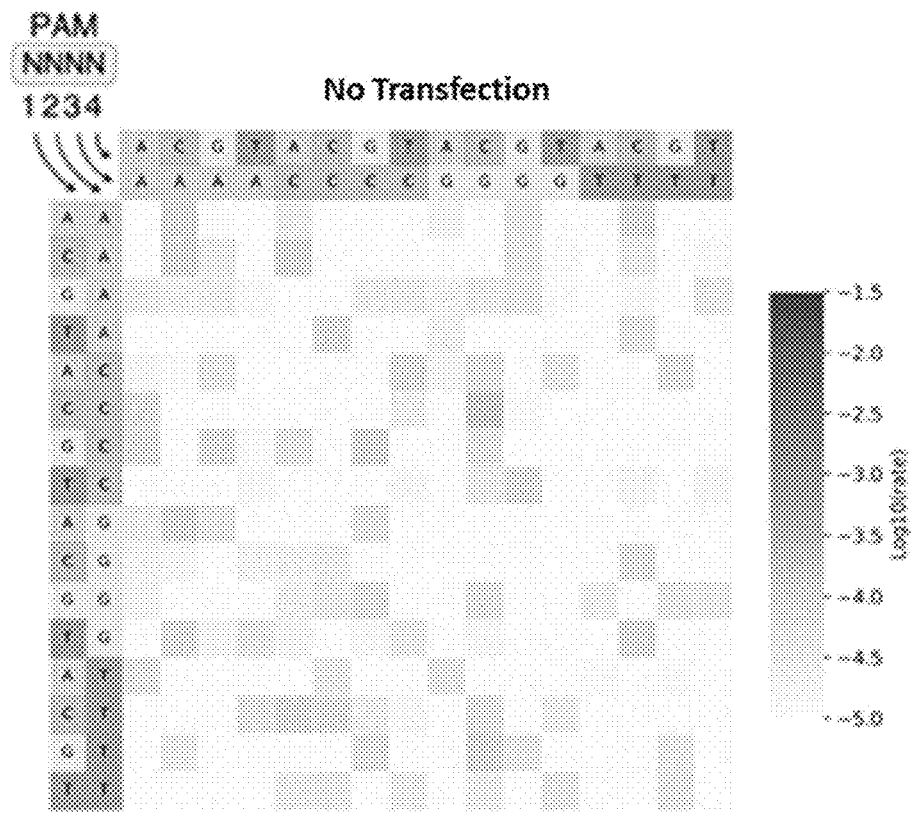

PAM sequences were tested for their effect on nucleases' editing efficiency following the method using spacer 3 of Walton et al. (Walton RT, et al., Science. 2020 Apr. 1 7;368 (6488): 290-296, incorporated herein by reference in its entirety). PAM sequences were tested for various nucleases (SEQ ID NOs: 6, 7, 1080, 1082, 1086, 1091, and 1096). Results are shown in FIGS. 6A-C and most preferred PAM sequences for each nuclease are listed in order of preference in Table 5.

TABLE 5

Preferred PAM Sequences for Exemplary Nucleases

| Nuclease SEQ ID NO: | Preferred PAM sequences |
|---|---|
| 6 | TTTA, TTTT, TTCA, ATTA, CTTC, GTTA, CTTA, TTCC, TTTC, TTTG, TTCT, GTTC, ATTC, ATTG, ATCA, TTCG, GTTG, ATCC, TACA, CTCC, TGTA, TCCC, TGTC, CTTG, GTCA, TGCA, TCCA |
| 7 | TTTT, TTTG, TTTA, TTCA, TTTC, TTCC, GTTA, CTTC, ATTA, CTTA, GTTC, ATTC, TTCT, GTTG |

TABLE 5-continued

Preferred PAM Sequences for Exemplary Nucleases

| Nuclease SEQ ID NO: | Preferred PAM sequences |
|---|---|
| 1080 | TTTA, TTTG, TTTC, TTCC, CTTA, TTCA, CTTG, CTTC, CTCC, TTCT, ATTA, CTCA |
| 1096 | ATTA, TTTG, TTTT, GTTA, TTCT, GTTC, TTTA, TTCA, ATTC, CTTA, TTTC, CTTC, ATTG, TTCC, GTTG, TTCG, ATCA, CTTG, TCCC, GTCA, ATCC, TGTA |
| 1082 | GTTA, CTTG, TTTT, ATTA, TTTA, GTTC, TTTG, GTTG, ATTG, CTTC, CTTA, TTTC, TTCC, ATTC, TTCA, TGTA, TTCT, TTCG, TGTC, ATCA |
| 1086 | TTTC, CTTG, TTTG, GTTA, CTTC, CTTA, GTTG, ATTA, ATTG, TTTT, TTTA, ATTC, TGTA, TTCA, GTTC, TATA, TTCC, TATG, AGTA, CGTA |
| 1091 | TTTG, TTTA, TTTT, TTTC, TTCC, CTTA, TTCA, CTTC, TTCT, CTTG, TCTA, ATTA, GTTA |

Example 7

NGS Analysis

Figure 7:
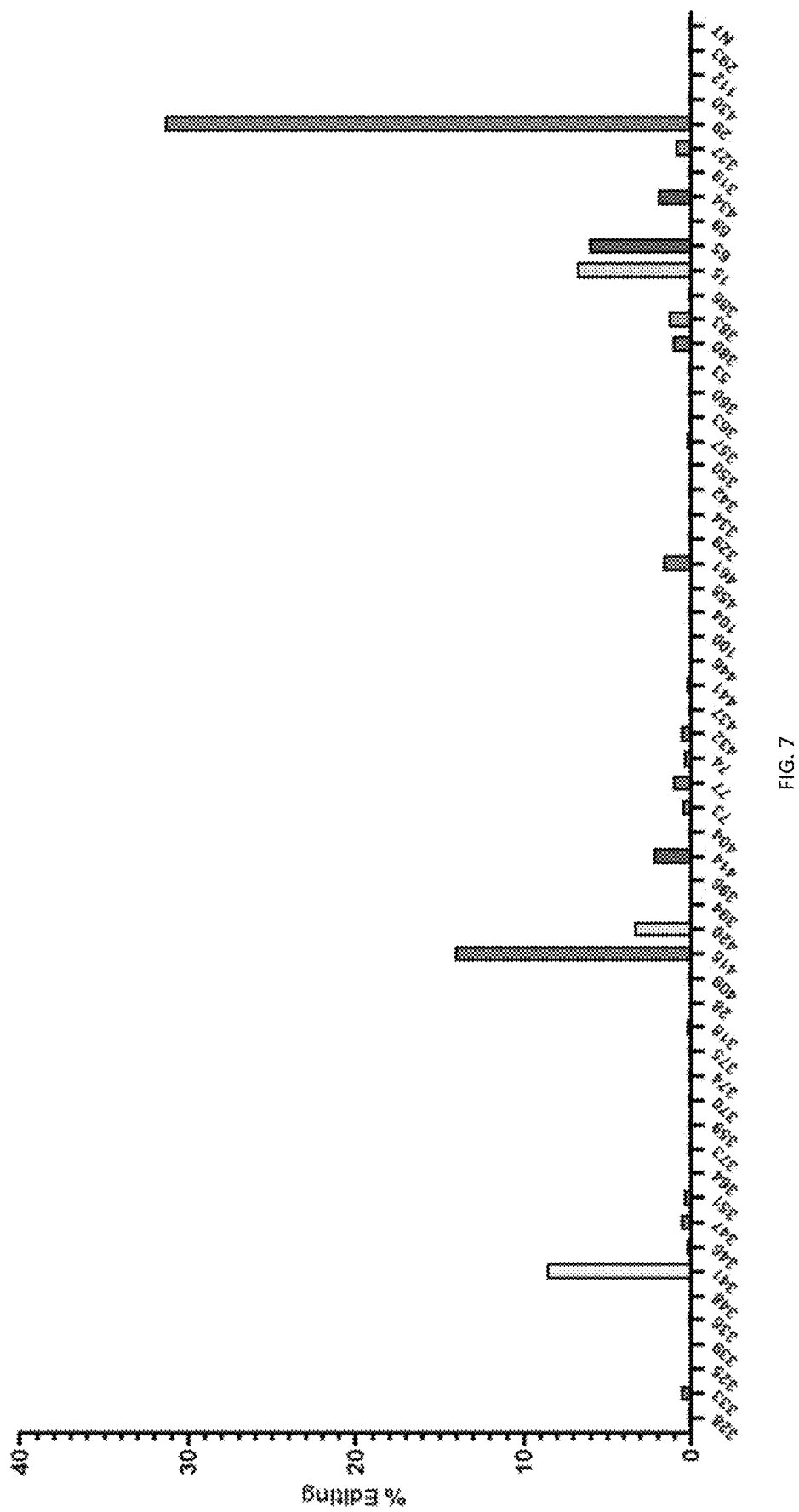
FIG. 7 is graph of editing efficiencies, for the indicated nucleases identified by SEQ ID NO, as determined by indel frequency in the target gene DNMT1.
Figure 8A:
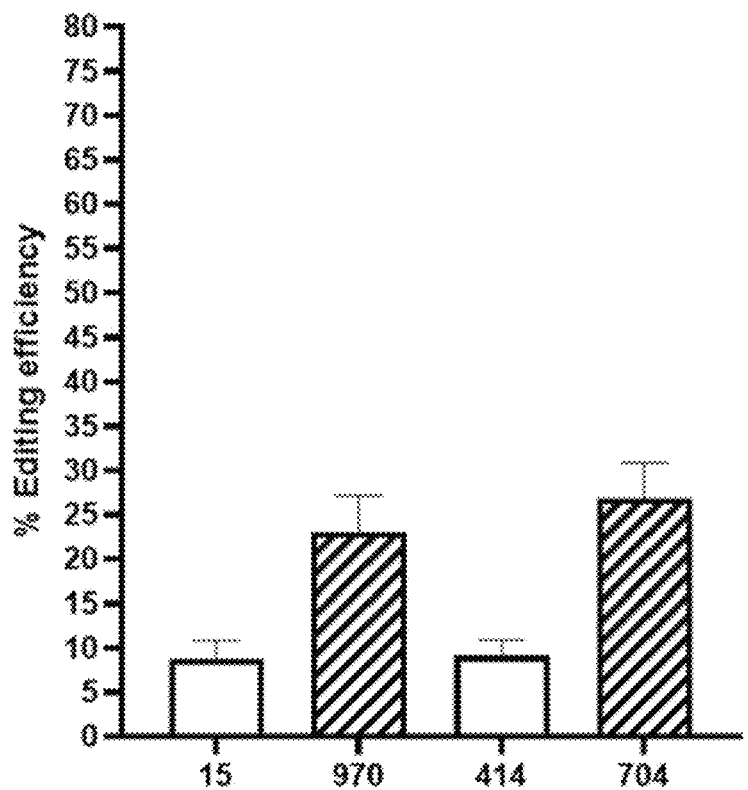
FIGS. 8A-8D are graphs of editing efficiencies, for the indicated nucleases identified by SEQ ID NO, as determined by the method used for the data shown in FIG. 7.
Figure 8B:
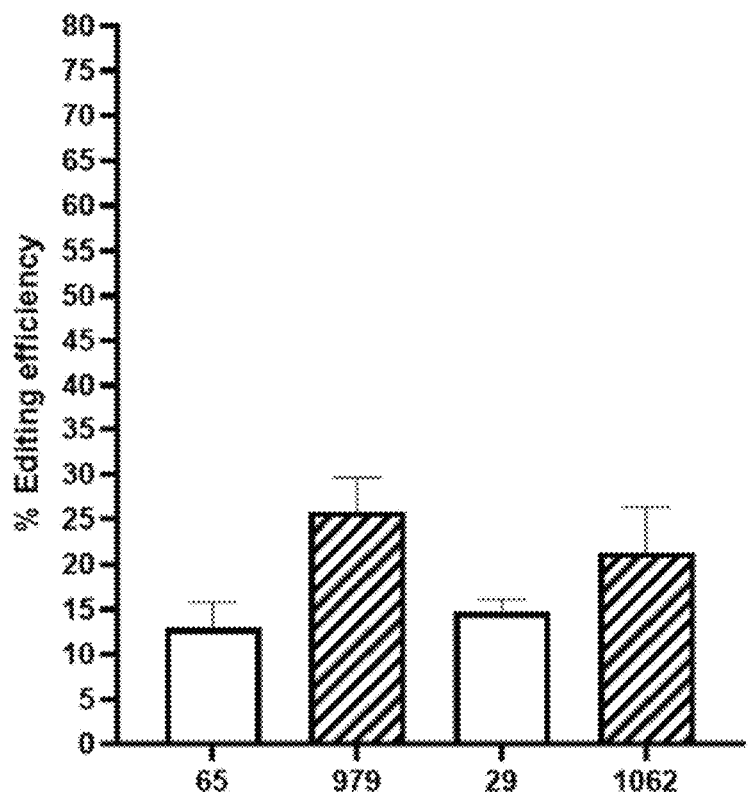
Figure 8C:
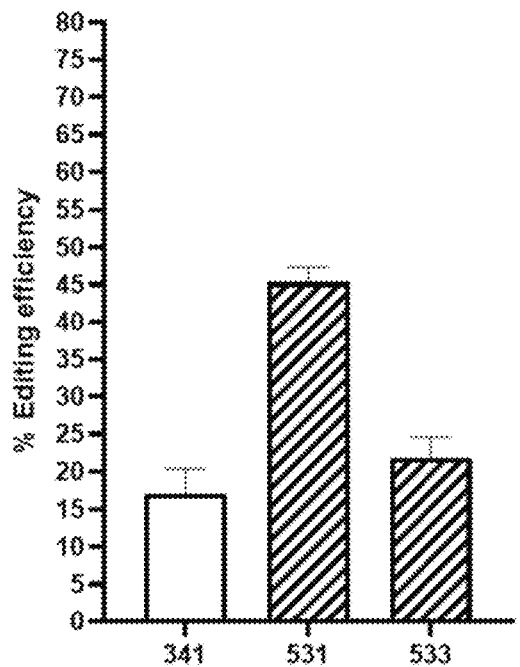
Figure 8D:
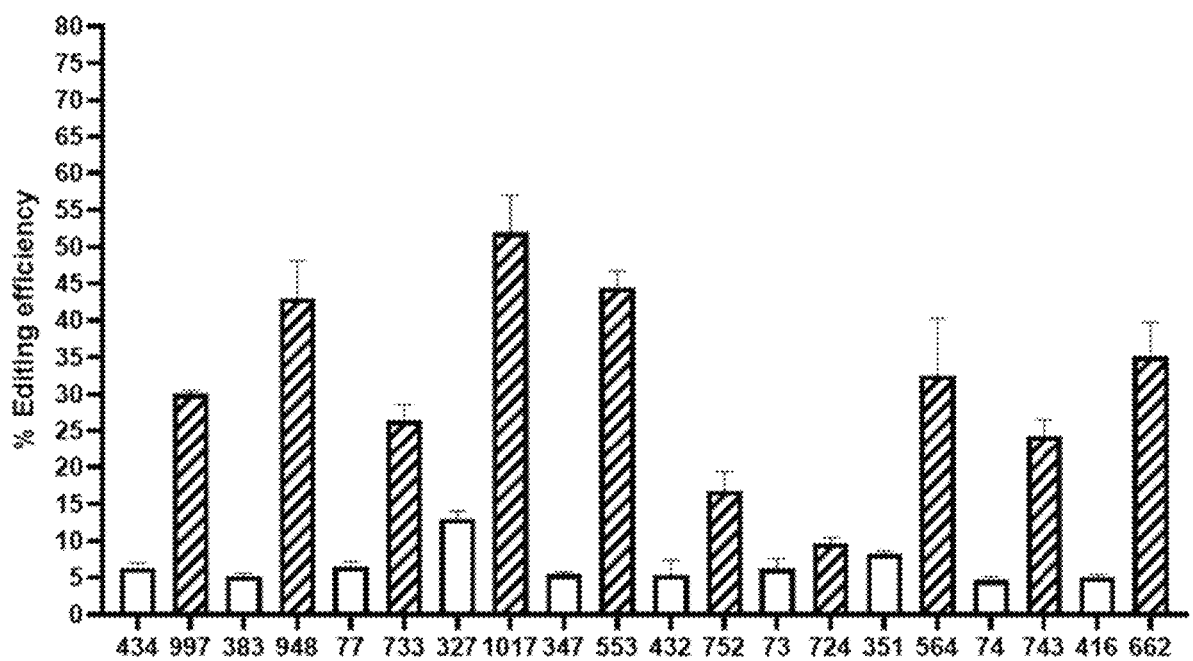

Nuclease editing efficiency Nuclease editing efficiency was determined by indel frequency in DNMT1 target gene. Twenty-six nucleases (FIG. 7) were tested in HEK293T cells through plasmid transfection using Mirus Transit 2020 reagent. Fifty thousand cells were plated per well of a 96 well plate and immediately transfected with 150 ng of nuclease expression vector and 50 ng of sgRNA vector. Samples were incubated for 72 h and harvested with QuickExtract (Lucigen). About 200 ng of genomic DNA was amplified using KAPA HiFi polymerase and primers specific to the targeted region on DNMT1 with Illumina adapters (ACACTCTTTCCCTACACGACGCTCTTCC-GATCTgttcccttagcactctgcc (SEQ ID NO: 1113) and GACTGGAGTTCAGACGTGTGCTCTTCCGATCTct-catggcaaaagcagtaatcagaac (SEQ ID NO: 1114)). 2 µL of this first 25 uL PCR was input to a second PCR using Illumina P7 barcoded primers (New England BioLabs kit #E6609S). PCR products were checked on a 2% agarose gel for purity and cleaned (ZYMO kit #D4034). Samples were then sequenced (Illumina MiSeq system), which returned 100-400 k 150 bp paired-end reads per sample. Editing analysis was performed by CRISPResso2 with the option "--cleavage_offset 1" (Clement, Kendell, et al. Nature biotechnology 37.3 (2019): 224-226, incorporated herein by reference in its entirety). The percentage of nucleotide insertion or deletion mutations (indels) around the cut site was calculated for transfected and non-transfected cells without including substitution-only mutations (FIG. 7). Additional nucleases with engineered mutations were compared using the assay described above. Results are shown in FIG. 8. The striped bars represent nucleases with engineered mutations and the open bars are the parent nucleases.

The scope of the present invention is not limited by what has been specifically shown and described hereinabove. Those skilled in the art will recognize that there are suitable alternatives to the depicted examples of materials, configurations, constructions, and dimensions. Variations, modifications, and other implementations of what is described herein will occur to those of ordinary skill in the art without departing from the spirit and scope of the invention.

Numerous references, including patents and various publications, are cited and discussed in the description of this invention. The citation and discussion of such references is provided merely to clarify the description of the present invention and is not an admission that any reference is prior art to the invention described herein. All references cited and discussed in this specification are incorporated herein by reference in their entirety.

SEQUENCE LISTING (1224 sequences)

SEQ ID NO: 1 - protein, 1213 aa, unidentified
MNIYENFTNMYQVNKTIRMGLKPICKTDENIAKFLEEDKERSDKYKIAKEIIDKENRAFIEDRLKDFSISGLDEYLELLKQKKNLTKNQNEMKKEISKQLTEVQKKMRNEISTQLEGFPKFDSKYKFRYITDKEDIKILEDFKNKKFTTYFKGFNDNRKNVYSKENISTSIGHRVVHENLPKFISNFRTLNKAIEVFGTGKINEDFKNNGINVTVEELIKIDYFNKVLTQSGIDLYNNLIGILNQNINLYNQQQKVKKNKIGKLEILYKQILSKTDKVSFIEEFTEDNQLLECINEYFKEKCSLITVDLKDLLENIDTYNLNGIFIKSDKFLGNISNYLYKDWWYISNLINEEYDYKHKNKVRDDKYYETRKKAIDKIKYFSIGHIDELLKDKNVLAVENYFKEKINLVVKEFNAYLNKFNEYKFINELKTDEIAVEIIKNLCDSIKNVQGIVKPLIVMGNDKDDSFYGDINYIWDELNKFNKIYNMVRNYLTKKDYIDEKIRLTFNNPQLLGGWSYNKESDYSSFILKDNKYYYLAIMNPNSKSKLKDLEKPENDEDTIYKMKYYQASDPAKSIPNLMVINGKTKKKNGRKVNGENIELERLRNEYLPTEINEIRKSKAYLRSSSSFSDEALIKYIDYYKERVKEYFNEIDFKFKETCEYKQFNEFAEDVNLQAYQISFIGVSKKYIKSLIDDNKIYLFKIYNKDFSENSKGIPNLHTLYFKMLFDKENLENPIYKLSGNAEMFFRKGNLDLDKTTIHHANKPINNKNPNNRKKQSVFKYDIIKNRRYTVDKFALHMSITTNFQVYENKNVNETVNRALKYCDDIYAIGIDRGERNLLYACVVNSRGEIVKQVPLNFVGNTDYHQLLAKKEEERMNSRKNWKIIDNIKNLKEGYLSQAIHIITDLMVEYNAVLVLENLNFRFKEKQMKFESNVYQKFEKMLIDKLNFLVDKKLDKNANGGLFNAYQLTEKFTNFKDMKNQNGIIFYIPAWMTSKIDPVTGFTNLFYIKYESIEKAKEFFGKFKSIKFNKVDNYFEFEFDYNDFTDRAQGTRSKWTVCSFGPRIEGFRNPEKNNSWDSREIDITEKIKNLLDDYNVSLDEDIKAQIMDINTKDFFEKLIKYFKLVLQIRNSKTGTDIDYIISPVKNKQNEFFDSRKQNEKMPMDADANGAYNIARKGLMFIDIIKETEDKNLKMPKLFIKNKDWLNYVQKSDL

SEQ ID NO: 2 - protein, 1158 aa, unidentified
MSKFQNLYTINKTLRFGLKPFGKTLENFNKTNLLQLDEYKAKHRKEVQRLFDENFKQLIEERLRGLSLDTQALEEAFDINKRDAALISLKKQVTGICYDSEMKKTYLQADKHFQKLLAAGPNQAMVCTYDKFSTYFVNFFDIRTHIFKGDTSGSIAYRLIDENLTIFKKNVDKIAKLPVGLKDEVEELADIESLQSYNSYLTQSGITEYNELLGGIAYEDGTKLQGINEKINLYGQKNKLKLPRLESLYKMILSDRETQSFVLSIIENDAELIGQISTLLEDVLLSKTLALSDVDGVFIKYTQLGNLPGVPYTVINSKINEAFDATYTGKKEGEKYKVTKKKTIEKDVYSLSKIEKLFQDSDINVSEALKNKYGVLIASYEEAKGLFNSIDWTEIKNIKQSGHTIIIKDVLDALKNIQFFYNLFDVVEENLNPSIEFYNELSLNKNQLGNEFNSTYNKARNYLTKKEYSEEKFKLNFDSPTLADGWDVNKETANLTILLRRFNSERNNYDYFLGVWKKAVPSREKNLIINADGEFEKMDYKLYPDPSKMLPKQFVSAQSWFDKYPASPEFMGKYEAGLHKKGNNFDIEFLHELINRYKHGLKHHENKYEETFDFELKETEEYSEYSEFIQDVSKSNYKVKFNHVAGVEELVEEGKLYLFQIWSKDFSTFSKGTKNLNTIYFESLFSEENLEKRIFKLSGGAELFYRPKSLTYTKELMEKGHHYNELKDSFNYPIIKDKRYTEDKFMFHVPIQINYGAENLGPVKLNNRINENIDGFTHIIGIDRGERHLVYISVVDVKTGKIVEQKHLDEIVNIDSKGKKHCTPYLQKLDERSKTRDQERKSWEAIETIKELKDGYISQVVNEICTLQQKYNALIVMENLNLGFKRSRFKVEKQIYQKFETALIKKFNYIIDKKDNSTYLHGLQLANPIQTLNSIGKQSGIIFYIPAWNTSKIDPTTGFVNLLYGADLRYTNKEQAEAFINKLDKIYFEDGVFKFDIDFKKWNQRYAKSCTKWTLTSYGTRVETKRDVIKNNMWCSNEIDLTAEFEKILNKRDGSLKTCDVETYKRFLYLFKLLLQIRNSITGTDTDYMISPVIAADGQQFDSRVVGMSLPNGLPKDADANGAYNIARKGLMAVHNIKAGFKKPFEISNEEYLEYLQK

SEQ ID NO: 3 - protein, 1237 aa, unidentified
MHTMKKINELTALYPLSKTLRFELKPIGKTLDHIEQKGLIVQDEQRAEEYKQVKKIIDSYHKEFITMCLKGLKLNMVYLERYESLAREVHRDEAEFDKVKAALRKQIVEAFKQGGSYNDLFKKELIQKHLPEFVESEEEKKMVANFSKFTTYFTGFYENRKNMYSDEEKSTAIAYRLIHENLPLFLDNMRSFRKIAESEVGGHFAKIEVRFEEYLNVEHLAEMFELDYFSDTLTQEQIAVYNSVIGGRTLDDGTKIQGINEYVNLYNQQHKEARLPLLKPLYKMILSDRVALSWLPENPFESDGEMVEAIKEMCQSLKEVLMGNDGLRNLLLNIDLYDIEHIYIANDLGLTDISQQMFGQYDVYASAIKQKLRQGVKQSPKERREPELFEERINRLYKSAKSFSIADLNSHTDANHTIESYFKQLGAYDREGEQRINLFTQIEMAQIEATDILAGKHGNISQSDKEIAILKGLLDAYKSLQHFVKPLLGHGDEADKDNEFDAKLREAWNALDIVTPLYNKVRNWLTRKPYSVEKIKLNFENAQLLGGWDVNKEPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDMADTTVHRASQPLVNKNALNKKRHSTFDYDIVKDRRYTVDKFQFHVPMTMNFKAVGRDNINSEVLNIIRNGGIKHIIGIDRGERHLLYLSLIDLRGNIVKQMTLNDIVNEYRGNTYSTNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKARDFFSKFDSIRYNDAKNWFEFAFDYNEFTEKAKDTRTRWTLCTWGTRIRTFRNPAKLNQWDNEEVVLTDVFKKAFDEAGIDIHSNLKEAICILTEKKHLESLMHLMKLLLQMRNSITNSEIDYLLSPVADENGHFYDSRTCDDTLPKDADANGAYNIARKGLWAIRTIQESSETERPNLALKNQDWLRFAQQKPYLND

SEQ ID NO: 4 - protein, 1239 aa, unidentified
MKQLNDLTGLYSLSKTLRFELKPIGKTLEHIESKGFITQDEKRAEEYKRVKDIIDRYHKSFITMCLCGFKFNQEDLDTYAALAEDFNRDEKAFEESKKTLRKQIVGAFKKGGGYSDLFKKELIQKHLPEIVTDDEEKKMVENFSKFTTYFTGFNENRKNMYSDEEKSTAIAYRLIHDNLPMFLDNTRSFSRIADSDVRQSFCKIESSFSEYLNVEHLAEMFQLDYFSETLTQEQIAVYNHVVGGRTLEDGTKIQGINEYVNLYNQQHKDNRLPLLKPLYKMILSDRVALSWLPDEFANDKEMIDAIKETYDSLKENLTGDGDGSLRNLLLNINNYDIEHIYIANDLGLTDISQQMFGQYDVYTSAIKQELRNSVTPTAKERREPELYAERINKLFKSTKSFSVAYLNSLVDAEHTIQNYYQQLGAYDRDGEQRINLFTQLEMAYVAAKDILSGKHGNISQTDAEIAIIKNLLDAYKSLQHFIKPLLGNGDEADKDNEFDAKLREVWDALDIVTPLYNKVRNWLTRKPYSTEKIKLNFENAQLLNGWDKNKETDCTSVLLRKDGKYFLAIMDKKANRAFDVEDLPCDGICFEKMNYKQIALPMGLGAFVRKCTGSAKKLGWTCPSSLLNKDMKIIIKDDEATNVLPSLIECYKDFLNIYEKDGFKYKDFNFKFKPTHEYKKLSHFFAEVPTQGYKITFRKVSESFINQLVDEGKLYLFQIWNKDFSEFSKGSPNMHTLYWKMLFDERNLADVVYKLNGQAEVFYRKSSLDVANTTIHKAHQPILNKNQENKKQQSTFDYDIIKNRRYTVDKFQFHVPISINFKATGRDNVNSQVLDIIRNGGIKHIIGIDRGERHLLYLSLIDLKGNIVKQMTLNDIVNEYNGNTYATNYRDLLAEREGNRTEARKNWKKIENIKDIKQGYLSQVVHIISKMMVEYDAIVVLEDLNMGFMRGRQKIERSVYEQFEKMLIDKLNYYVDKQKDVNEAGGLLHALQLTSRFESFKKLGKQSGCLFYIPAWNTSKIDPVTGFVNLFDTRYTNADQARKFFSLFDSIRYNAEKNWFEFAFDYDKFTTKAKGTRTRWTLCTYGTRIRTFRNPAKLNQWDNKEVVLTDEFKKAFADAGIDIHGNLKEAICSLEDKKYLEPLMHLMKLLLQMRNSITNTEVDYLLSPVADKNGSFYDSRVCSYALPKDADANGAYNIARKGLWAIRQIQETPVGERPNLAIKNNEWLKFAQQKPYRDE

SEQ ID NO: 5 - protein, 1246 aa, unidentified
MMETFSDFTNLYPLSKTLRFRLIPVGKTLRHFIDSGILEEDQHRAESYVKVKAIIDDYHRSYIESSLSGFELPVESMGKSNSLEEYYLYHNIRNKTEDIQNALSKVRNNLRKQIVAQLTKNEMFKRIDKKELIQNDLIDFVKNEPDANEKIALISEFRNFTVYFKGFHENRKNMYSDEEKSTSIAFRLIHENLPKFIDNMEVFAKIQNTSISEKFDAIQKELCPDSVAFVDMFKLGYFNRTLSQKQIDAYNTVISGRTTAEGEKIKGLNEYINLYNQQHKQEKLPKMKLLFKQILSDRESASWLPEKLENDKQVVGALVDFWNTIHDTVLAEGGLKTVISLLVSYSLEGIFLKNDLQLTDVSQKATGSWSKIPTAIKQKLKAMNPQKKKESYEGYQERIDKIFKSYKSFSLAFINECLHGEYKIEDYFIKLGAINTDLLQKENHFSHILNTYTDIKEVIESYSESTDTKLIRDNGSIQKIKQFLDSVKDLQAYVKPLLGNGDETGKDERFYGDFVEYWNLLDLITPLYNMIRNYVTQKPYSVEKIKINFQNPTLLNGWDLNKETDNTSVILRRDDKYYLAIMTSKFRKVFLEYPSGSDRSCYEKMEYKLLPGANKMLPKVFFSKSRIQEFMPDERLLSNYEKGTHKKTGNCFSLTDCHALIDFFKKSLNKHEDWRNFGFKFSDTSTYTDMSGFYKEVENQGYKLSFKPIDAVYVDQLVDEGKIFLFQIYNKDFSEHSKGTPNMHTLYWKMLFDETNLGDVVYKLNGEAEVFFRKASIKVSSPTHPASVPIKKKNPKHMDEERILKYDLIKDKRYTVDQFQFHVPITMNFKSDGNGNINQKVVEYLRSASNIHIIGIDRGERNLLYLVVIDGSGKICEQFSLNEIKVEHNGETYSTNYHDLLDIKENERKQARQSWQSIANIKELKEGYLSQVIHKISELMVKYNAIVVLEDLNTGFMRGRQKVEKQVYQKFEKMLIEKLNYLVFKKQSLNLCGGLMHAYQLTNKFEGFNKLGKQSGFLFYIPAWNTSKMDPVTGFVNLFDLKYESIDKAKSFFSKFDSIRYNVERDMFEWKFNYDKFTKKAEGTKTNWTVCSYGNRIITFRNPNKNSQWDNKEINLTENIKLLFERFGIDLSSNLKDEIIQRTEKEFFIELISLFKLVLQMRNSWTGTDIDYLVSPVCNEKGEFFDSRNVDKALPQNADANGAYNIARKGLIFLDRIKESTSDKKLNCSITNKEWLLFVQNCCKNG

SEQ ID NO: 6 - protein, 1158 aa, synthetic construct
MSKFQNLYTINKTLRFGLKPFGKTLENFNKTNLLQLDEYKAKHRKEVQRLFDENFKQLIEERLRGLSLDTQALEEAFDINKRDAALISLKKQVTGICYDSEMKKTYLQADKHFQKLLAAGPNQAMVCTYDKFSTYFVNFFRIRTHIFKGDTSGSIAYRLIDENLTIFKKNVDKIAKLPVGLKDEVEELADIESLQSYNSYLTQSGITEYNELLGGIAYEDGTKLQGINEKINLYGQKNKLKLPRLESLYKMILSDRETQSFVLSIIENDAELIGQISTLLEDVLLSKTLALSDVDGVFIKYTQLGNLPGVPYTVINSKINEAFDATYTGKKEGEKYKVTKKKTIEKDVYSLSKIEKLFQDSDINVSEALKNKYGVLIASYEEAKGLFNSIDWTEIKNIKQSGHTIIIKDVLDALKNIQFFYNLFDVVEENLNPSIEFYNELSLNKNQLGNEFNSTYNKARNYLTKKEYSEEKFKLNFDSPTLARGWDVNRETANLTILLRRFNSERNNYDYFLGVWKKAVPSREKNLIINADGEFEKMDYKLYPDPSKMLPKQFVSAQSWFDKYPASPEFMGKYEAGLHKKGNNFDIEFLHELINRYKHGLKHHENKYEETFDFELKETEEYSEYSEFIQDVSKSNYKVKFNHVAGVEELVEEGKLYLFQIWSKDFSTFSKGTKNLNTIYFESLFSEENLEKRIFKLSGGAELFYRPKSLTYTKELMEKGHHYNELKDSFNYPIIKDKRYTEDKFMFHVPIQINYGAENLGPVKLNNRINENIDGFTHIIGIDRGERHLVYISVVDVKTGKIVEQKHLDEIVNIDSKGKKHCTPYLQKLDERSKTRDQERKSWEAIETIKELKDGYISQVVNEICTLQQKYNALIVMENLNLGFKRSRFKVEKQIYQKFETALIKKFNYIIDKKDNSTYLHGLQLANPIQTLNSIGKQSGIIFYIPAWNTSKIDPTTGFVNLLYGADLRYTNKEQAEAFINKLDKIYFEDGVFKFDIDFKKWNQRYAKSCTKWTLTSYGTRVETKRDVIKNNMWCSNEIDLTAEFEKILNKRDGSLKTCDVETYKRFLYLFKLLLQIRNSITGTDTDYMISPVIAADGQQFDSRVVGMSLPNGLPKDADANGAYNIARKGLMAVHNIKAGFKKPFEISNEEYLEYLQK

SEQ ID NO: 7 - protein, 1237 aa, synthetic construct
MHTMKKINELTALYPLSKTLRFELKPIGKTLDHIEQKGLIVQDEQRAEEYKQVKKIIDSYHKEFITMCLKGLKLNMVYLERYESLAREVHRDEAEFDKVKAALRKQIVEAFKQGGSYNDLFKKELIQKHLPEFVESEEEKKMVANFSKFTTYFTGFYRNRKNMYSDEEKSTAIAYRLIHENLPLFLDNMRSFRKIAESEVGGHFAKIEVRFEEYLNVEHLAEMFELDYFSDTLTQEQIAVYNSVIGGRTLDDGTKIQGINEYVNLYNQQHKEARLPLLKPLYKMILSDRVALSWLPENPFESDGEMVEAIKEMCQSLKEVLMGNDGLRNLLLNIDLYDIEHIYIANDLGLTDISQQMFGQYDVYASAIKQKLRQGVKQSPKERREPELFEERINRLYKSAKSFSIADLNSHTDANHTIESYFKQLGAYDREGEQRINLFTQIEMAQIEATDILAGKHGNISQSDKEIAILKGLLDAYKSLQHFVKPLLGHGDEADKDNEFDAKLREAWNALDIVTPLYNKVRNWLTRKPYSVEKIKLNFENAQLLRGWDVNREPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDMADTTVHRASQPLVNKNALNKKRHSTFDYDIVKDRRYTVDKFQFHVPMTMNFKAVGRDNINSEVLNIIRNGGIKHIIGIDRGERHLLYLSLIDLRGNIVKQMTLNDIVNEYRGNTYSTNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKARDFFSKFDSIRYNDAKNWFEFAFDYNEFTEKAKDTRTRWTLCTWGTRIRTFRNPAKLNQWDNEEVVLTDVFKKAFDEAGIDIHSNLKEAICILTEKKHLESLMHLMKLLLQMRNSITNSEIDYLLSPVADENGHFYDSRTCDDTLPKDADANGAYNIARKGLWAIRTIQESSETERPNLALKNQDWLRFAQQKPYLND

SEQ ID NO: 8 - protein, 1244 aa, unidentified
MTHAFIFCLLYLKKTKYASGVHKEEKMKINAFINCYSMSKTLRFKLAPEYETEKNLLEKGFLDRDELRADDYDLMKKVIDKYHKHFIDKALEGFKFDLLQDYAEAFYSQSADDDGKKLEEIKKKMCKELATCFSKQDEFKLLDKKELVEKLIPAAEFIEDEEKDIAKRFKGFTTYFTGFNENRQNLYAAELKHGTIAFRLIEENLPAFLYNCKKGVKIFEGLDEDVAETLNNELGEILSIGNVKDILNVEYYNKTLTQNGIDVYNQIIGGYTKEDGTKIKGVNEYVNLYNQTHDKKLPSLAKLKKQILSDSYSLSFLPAKFNDDSELLLSLKKFYSMVNEETGLSVEKAIQEMRDVFSHIDDCDLHNVFIDAKFINKVSNDVFGNWSVLIDGINAEYEKLNPFNGKNLDNYEEKRKAFLNKIESYSVDTLQAYSGKEEKIADYVQKRAVELCDSVACAYGNMSDKVINAREGKVKLYQDDEKTEIIKTFLDAVQEFKRFAEMFCYDGTDGDTTFYGEFANYYGQIAEIIPLYNKCRNYLTKKPYSEDKIKINFDNSQLLDGWDANKEKDYLTVLLLKGNNYYLGILDKNHKNVLIKDVPEKGQGEPCFKKMIYKLLPGPEKMLPKVVFSAKNIGFYNPDREILRIRENGTFKTGDGFNIDDCHRLIDFYKECISKNEDWKTFGFKFKETSEYKNIGQFYNEVKEQGYKISFTDIPESYVKDLVNDGKLYLFKFDNKDFSPYSKGKKNLHTMYFEGIFDPENIKEKVYALNGGGELFFRRASLNYDKPTHPKNVPIKNKTYEFRTDNAKKETSTFEYDLIKDKRYTKDQYTLHCPVTLNFKERGIERINDLVRQSLRESDDNYVIGIDRGERNLIYISVIDGKGKIVEQFSMNNLSSGNDVSIDFHKMLETRERERDASRKNWNTIDNIKDLKQGYLSYVVKKICDLVVKYDAIVAMEDLNVGFKHGREKFERQVYQKFEKALVDKMSYIVNKNASPHSDGGLFRAYQLTNKKYNENEKQNGFIFYVRAWNTSKIDPTTGFVNMLPLKYQSKEKSKEFFDKFEDIFYDENKDMFGFTFRYDDFGINIDHKNEWTAYSNGERIITVRNSFGKWDKEKIALTPAFKKLFDDYNVDCRGDVKRQIMNVDDKDFFVRLYKLLSYTMQLRNSDDVDDYILSPVVNAEGKFFDSRNSDGSLPCDADANGAYHIAKKAMWAIGKIKEADEESFKKTSLAIDNKTWLEFVQKA

SEQ ID NO: 9 - protein, 1270 aa, unidentified
MKRTKKERLTKVLSFELKPIGKTRQTITDKKLLKTDQEINERLDTVKPLIDLFYKHYIREALFLMGQPGSDYYIDFTKLEADYRFTSDKELSAEKHRVVVKNYQKDITEIQKIFHAAFLSVCPVKEKDLISAKLFEGIKKYVDTHLVGDPNYMEYQEIMENVTGCAVLLKKFMNTRLTALNTVGKRIMENFECYCNNIANIQLFMKSQVFSELEKNFPDLSSFQYADYYAKILTQEGIDYYNLMISGIFYPDGTRVKGFNMCVNEENIKNRNDHTYTGSFFRTLKKLDKQILYPAEKVFSIEHLDSDEEVRILFRELNGKVPTKKLLDIILLLKETTGDGIFVIGNDVHTLSHLCIKDHNTYPELLEKNYIVQRTNELETVSKQSERKKIEKNIINARSIVGSGNIQYSLEELSVICKSDVKSLYIHELELLYKRVLSKKELFDKSGLIKFGDFHSKVNKKIIKDYLESINDFRHVVQLIARGAESEQADILFYEDLNKQLECFTTAKKALNLVRNYVTRKPADTAKGATTETFFGSAQKTIAKWWNGVDKIDVGKNLILQKDNRYFFATLLPGNSISADSLLTGKSNYSVLTVKKGSNGMKNELPKRMFGQSNGKISVKKMFEADIDYCEWSGTKQDMKYPVKISRELYEANEKGLKTQDAVKKHLCTEEERRYWEVETIRLAQQILPLTVSYANVNWNFKAPEDYSSWLEFCAYCDTKAAYYSWLDVDENQINSLVEDGAMLLFQISHRDLYKNKKNPDSYVKTLEYLLSEENFKNPVIHLNGAPSFQYRKAVYERKITHKKGSILVNRWDKNGEQILNDIYMEIYNYYQGYVSKEELSKEALEELPFVRTKTAWMNFIKSAKYTKEKFLIRIIYTKNADVLNYGYNMINEETKEEIQEAGKAVLSISRSIYDLLYCVLFDKNGKVIEKRSLNIINGIDYYSLLKKIDKYRKSEKSNNWEYTTRIKDIRTHYIDLAIGEIVKYVTTYDAVIVLEKVNNSFKNKMQMIDNQLFKTFESRLELRLNDCYNKNISDGEAGSLTNPYQLTKQGNLSSVQNGYVFYLNGAYTNMCPVSGFVNFFNFGNINALKTKKELLLAMKKISYINNSFQFEFNYNSMERFLKDSWKNTTKEVKKTGYVLKTDWLITAVGPVTRYDREKKKNGYVADRTQKAYDLLKEHNCINDNGNVLVDTLNNTSLNAVYDLFAETVTNTTVRKCDVVPEEYYVSPVAGACPDISPSEIMAENLGRKFFYFMMHDTTEGYIGYMQEQH

SEQ ID NO: 10 - protein, 1284 aa, unidentified
MKDFTHQYSLSKTLRFELKPVGETAERIEDFKNQGLKSIVEEDRQRAEDYKKMKRILDDYHKEFIEEVLNDDIFTANEMESAFEVYRKYMASKNDDKLKKEITEIFTDLRKKIAKAFENKSKEYCLYKGDFSKLINEKKTGKDKGPGKLWYWLKAKADAGVNEFGDGQTFEQAEEALAKFNNFSTYFTGFNQNRDNIYTDAEQQTAISYRVINENMTRYFDNCIRYSSIENKYPELVKQLEPLSGKFAPGNYKDYLSQTAIDIYNEAVGHKSDDINAKGINQFINEYRQRNSIKGRELPIMSVLYKQILSDINKDLIIDKFENAGELLDAVKTLHRELTDKKILLKIKQTLNEFLTEDNSEDIYIKSGTDLTAVSNAIWGEWSVIPKALEMYAENITDMNAKAREKWLKREAYHLKTVQEAIEAYLKDNEEFETRNISEYFTNFKSGENDLIQVVQSAYAKMESIFGIEDFHKDRRPVTESGEPGEGFRQVELVREYLDSLINVEHFIKPLHMFRSGKPIELEDCNSNFYDPLNEAYKELDVVFGIYNKVRNYVTQKPYSKDKFKINFQNSTLLDGWDVNKESANSSVLLLKNGKYYLGVMKQGASNILNYRPEPSDSKNKINAKKQLSEIALAGATDDYYEKMIYKLLPDPAKMLPKVFFSAKNIEFYNPSQEIIYIRENGLFKKDAGDKESLKKWIGFMKTSLLKHPEWGSYFNFEFEPAEDYQDISIFYKQVAEQGYSVTFDKIKTSYIEEKVASGELYLFEIYNKDFSPHSKGRPNLHTMYWKSLFEKENLQNLVTKLNGEAEVFFRQHSIKRNEKVVHRANRPIQNKNPLTEKKQSIFEYDLVKDRRFTKDKFFLHCPITLNFKEAGPGRFNDKVNKYIAGNPDIRIIGIDRGERHLLYYSLIDQSGRIVEQGTLNQITSTLNSGGREIPKTTDYRGLLDTKEKERDKARKSWSMIENIKELKSGYLSHIVHKLAKLMVKNNAVVVLEDLNFGFKRGRFKVEKQVYQKFEKALIEKLNYLVFKDARPAEPGHYLNAYQLTAPLESFKKLGKQSGFIYYVPAWNTSKIDPVTGFVNQFYIEKNSMQYLKNFFGKFDSIRFNPDKNYFEFGFDYKNFHNKAAKSKWTICTHGDKRSWYNRKQRKLEIHNVTENLASLLSGKGINFADGGSIKDKILSVDDASFFKSLAFNFKLTAQLRHTFEDNGEEIDCIISPVAAADGTFFCSETAKKLNMELPHDADANGAYNIARKGLMVLRQIRESGKPKPISNADWLDFAQQNED

SEQ ID NO: 11 - protein, 1245 aa, unidentified
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 12 - protein, 1245 aa, unidentified
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVVQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNAYTDVKEAIGFYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDGNCYEKMEYKLLPGANKMLPKVFFSKSRINEFMPNERLLSNYEKGTHKKSGICFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLCSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNALGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 13 - protein, 1245 aa, unidentified
METFSGFTNLYPLSKTLRFRLIPVGETLKHFIGSGILEEDQHRAESYVKVKAIIDDYHRTYIENSLSGFELPLESTGKFNSLEEYYLYHNIRNKTEEIQNLSSKVRTNLRKQVVTQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLLEKFENDSQVVGAMVNFWNTIHDTVLAEGGLKTIIASLGSYGLEGIFLKNDLQLTDISQKATGSWSKISSEIKQKIEAMNPQKKKESYESYQERIDKLFKSYKSFSLAFVNECLRGEYKIEDYFLKLGAVNSSLLQKENHFSHILNTYTDVKEVIGFYSESTDTKLIQDNDSIQKIKQFLDAVKDLQAYVKPLLGNSDETGKDERFYGDLIEYWSLLDLITPLYNMVRNYVTQKPYSVDKIKINFQNPTLLNGWDLNKEMDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLNKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKANGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYDEFTKKAEGTKTDWTVCSYGNRIITFRNPDKNSQWDNKEINLTENIKLLFERFGIDLSSNLKDEIMERTEKEFFIELISLFKLVLQMRNSWTGTDIDYLVSPVCNENGEFFDSRNVDETLPQNADANGAYNIARKGMILLDKIKKNNGEKKLTLSITNREWLSFAQGCCKNG

SEQ ID NO: 14 - protein, 1245 aa, unidentified
METFSGFTNLYPLSKTLRFRLIPVGETLKYFIGSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGFYSESTDTKLIRDNGSIQKIKLFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 15 - protein, 1369 aa, unidentified
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQENRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLADGWDLNKEQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 16 - protein, 1302 aa, unidentified
MNYQLLFQKFVHLYPISKTLRFELIPQGATQKFITEKQVLLQDEVRARKYPEMKQAIDGYHKDFIQRALGNIDSQSFEQALQTFQELFLRSQAERSTEAYKKEFETTQTKLRELIVNSFEKGEFKQEYKSLFDKNLITNLLKPWVEKQSQTGDNNYTYHNDFNKFTTYFLGFHDNRKNIYSKEPHKTALAYRLIHENLPKFLENNKILRKIQNDHPALWEQLQALHHTMPQLFNGWDLSQLLQVSFFSNTLTQTGIDQYNTIIGGISEGENRQKIQGINELINLYNQKQDKKNRVAKLKQLYKQILSDRSTLSFLPQQFADDAELYHAINMFYLDHLHYQSMVNGHSYTLLERVQLLINELANYDLSKVYLAPNQLSAVSHQMFGDFGYISRALSYYYMQVIQPDYELLLASAKTTAKIEAIEKLKTAFLDAPHSLVVIQAAIDKYLQLQPSSKPHTQLTDFIISLLKQYETVADDQSIKIINIFSDIKGKYSCIKGLVNTESTSESKREILQNEKLATDIKAFMDAINNVIKLLKPFALNEKLAASVEKDARFYSDFEEIYQALLVFVPLYNKVRNYITQKPYSTEKFKLNFNKPTLLSGWDANKEADNLSILLRKNGNYYLAIMDTAKGANKAFEPKALNQLKVDDTTDCYEKMVYKLLPGPNKMFPKVFFSESRKAQFNPPQHIIESYNKKEHISSEAHFDLKKCHALIDWFKQCIELHEDWKHFNFKFSPTSQYSNISDFYKEVSEQNYKVHFQDIPADYIEQLVAEGKLYLFQIYNKDFSPHAKGKENLHTMYFKALFSEENLKQPVFKLSGEAEMFYRPASLQLENTTIHKAGEAMVAKNPLTPHATRTLAYDIIKDRRFTTDKYLLHIPISLNFHAQESMSIKKHNDLVRQMIKHNHQDLHIIGIDRGEKHLLYVSVIDLKGNIVYQESLNSIKSEAQNFETPYHQLLQHREEGRAQARTAWGKIENIKELKDGYLSQVVHRIQQLILKYNAIVMLEDLNFGFKRGRFKIEKQIYQKFEKALIHKLNYVVDKSTQADELGGVRKAYQLTAPFESFEKLGKQSGVLFYVPAWNTSKIDPVTGFVDLLKPKYENLDKAQAFFKTFASIIFNAKKDYFEFKVNLNQFAGLKAQAARAEWTICSYGPERHVYQKKNAQQGETVIVNVTEELKALFAKNNIEVAEGVELKEMICAQTQVDFFKRLIWLLQVLLALRYSSSKDKLDYILSPVANVLGEFFDSRHASTHLPQDSDANGAYHIALKGLWVIEQLKTAANTEKVNLAISNDEWLRFAQEKLYLT

SEQ ID NO: 17 - protein, 1226 aa, unidentified
MFNLYSNLRKLYPVQKTLRFELIPQGKTKENMEKEGIIREDEHRAKIYNKVKKYCDEYHKIFIEDCLKDIKLDNLNKYYELYSIDKKDEDQKEGFTKTQEKLRKQISESFKNNNKYKGLFQKDIIDTYLINIYKEDKQKLQDINEFNKFTTYFTGYNKNRENMYLEEEKSTAIAYRLINENLPTFVDNLKIYNKLLKFIPEIIEKIHIELAEYIQVNSIDEIFDINYYNDVLTQKGIECYNIIISGKTKDEGTKIKGINEYINEYNQTHTNKIPKLRELYKQILSDIDTASFKFDVIEDDIQLLDSINLYYQQIFPIISKVNELFSKINNYNLDLIYINNDGTLSNVSNEIYSDWSYIRNHISEKYDTEYTGRLKVGTEQYSKQKQEYLRKQRNYSLRFLINCMKDDKIIEYLSNNMQQTEIVEKIKMDFDNFKSIQIQEDYKCLIKSENSIAKIKKLLDDTKLLQVFMKTLIPKDKTIEKDNEFYSELISYYDVFRDIIPLYNKTRNYLTQKPYSNEKIKINFACTTLLNGWDLNKEEANLGVILLKDEKYYLGIMNPYCKKIFNVDNRDSDTNNNYKKMEYKLLPGPNKMLPKVFFSKSRINEFAPSDELLEKYNKGYHKKGKDFDINFCHELIDFYKKSLNKHEDWKNFNFKFKNTVEYNDISEFYREVEEQGYKIEYKEYSEKYINELVERGELYLFQIYNKDFSEYSKGKQNLHTMYWKAVFDPENIKDTIYKLNGNAEIFYRKKSIDEKITHPANIPVANKNENTIKAGKITSLFKYNLIKDKRYTVDKFQFHVPITMNFKSEKILNINQIVNKYLKYNDDIHVIGIDRGERNLLYVCVIDKDEKIVYQKSLNEIYNEYQGIQYSTNYHRLLNEKENKREQAREDWKNIENIKELKEGYMSQIIHILCELMRKYNAIIVIEDLNKGFKNSRIKVEKQIYQKFEQMFINKLNYVVFKDVPKLEEGGILNAYQLTNKFESFTKLGKQSGILYYIPAWCTSKIDPTTGFINRFYIKYENLEKSREFVNRMDNIRYNLDEELFEFDIDYSKFSDRLNDTKNKWTLCSYGERVYTHKNNKEIWVDDKIQLTDEFIKLFEKYKIDLNNIKNEIIEKADIEFFKGGENSLGFLQLFKLMVQMRNSITGQEEDNLISPVRNNEGIFFDTKAKIKGLPEDADANGAYNIARKGLMLIEQMKRTDDDKLNKIKYDITEKEWLNYIQNRGV

SEQ ID NO: 18 - protein, 1249 aa, unidentified
MKEQFINCYPLSKTLRFSLIPVGKTEDNFNKKLLLESDKQRAENYENVKSYIDRFHKEYIKSALANARIEKINEYAALYWKSNKDDSDAKAMESLEDDIRKQISKQLTSTANFKRLFGKELICEDLPAFLTDENEKETVECFRSFTTYFNGFNTNRKNMYSSEKKSTAIAYRCVNDNLPRFLDNIKTFQKIFDNLSDEAITKLNIYLYNRFGRKIEDIFSVDYFDFVLAQSGIDVYNSMIGVYTCSDGTKIQGLNQCINRYNKQVAKNEKSKRLPLMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLKSDYEKDYDKRLYKNEKATELVKNLLDAIKEFQQLVKPLNGTGKEENKDELFYGKFTSFYDSVADIDRLYDKVRNYITQKPYSKDKIKLNFDNPTFLKGWALGNEFANSAQLLRDGDNYYLAIMDKEFRNNIPKKYNSPISKEDVLQKIIYQQAADPSKDIPNLLVIDGVTVKKNGRKEKTGIHAGENIILENLRNTYLPENINRIRKEKTFLTSSENFSKDDLCEYIQYYICRAQEYYSSYNFTFKNASEYKSFSEFLDDVNSQAYQISYDNISKKQIMELVENGYLYLFKIYNKDFSKYSKGTPNLHTLYFKMLFDERNLSNVVYKLNGEAEMFYREASINDKEKITHHANQPIKNKNPDNEKKESVFEYDIIKDKRFTKRQFSLHMSITINFKAHGQEFLNYDVRKAVKYKDDNYVIGIDRGERNLIYISVINSNGEIVEQMSLNEIIGDNGYSVDYQKLLDKKEKERDKARKNWTSVENIKELKEGYISQVVHKICELVVKYDAVIAMEDLNFGFKRGRFPVEKQVYQKFENILISKLNLLIDKKAEPTENGGLLRAYQLTNKFDGVNKAKQNGIIFYVPAWDTSKIDPVTGFVNLLKPKYTSVSEAKKLFETIDDIKYNTNTDMFEFCIDYGKFPRCNSDFKKTWTVCTNSSRILSFRNEKKNNEWDNKQIVLTDEFKSLFNEFGIDYTSDLKASILSISNADFYNRLIRLLSLTLQMRNSIIGSTLPEDDYLISPVANDRGEFYDSRNYKGSNAALPCDADANGAYNIARKALWAINVLKDTPDDMLQKAKLSITNAEWLEYTQR

SEQ ID NO: 19 - protein, 1256 aa, unidentified
MEFKDFTNQYKMNKTLRFELKPVGHTLELIRQNAIISSDEGLAEAYQKVKKIIDEYHRYYIETQLANLQLQCEEQTDAKGKGKCNSLAEYYALRGDESDSGKKNFKKVKELLRKQVSDCLQKSAEYKTIFKKELIQVDLINFVNGLDISEEEKSKRRKLIEAFNNFTSYFVGFHQNRENMYTFEEKSTSIAYRLINENLPKFIDNISVFVKISEVPELKDKISQLTEDFSSYLGGVSVENVFKLEYFNKVVTQRQIEVYNALIGGRSEGDTKIQGLNEYINLYNQKHPEAKLPRFKVLYKQILSDREPISWLPEQFKRDGDLLDAVREYHEEMQLVAENIMVLLSDIKNYNLDGIFVSNDTQLTSISKALDENGNWGRIQRDFIEYFKSQNKKKKNEGDEKYYERMKDLYDANKSFSISEINSVAGLNVEEYFANMEVRDYTDDTARKKINVFDAISDAYSDVEYLLTSEYPKEKHLISEENDIESIKCLLDTWKSLQHFVKPLLGTGDEPAKDNAFYGEFNEYWDKLNKLNALYNKVRNYLTRKPYSDEKIKLNFRSAQLLGGWDQNKETDCLSVLFMKDGKYYLGIMNKRVKEDLDYNENKGNNKIFATKLSSTGDCYQKMVYKLLPGANKMLPKVFFSESRINEFAPSAKILHIREIGSYKSGDTFNLDDCHALIDFYKESLQKHEDWSKFNFEFPDTSEYSNINEFFEDVERQGYKVEFQPISVKVIDKFVNEGKLYLFEIYNKDFSEHSKGTPNLHTIYWKMLFDERNLKDVVYQLNGQAEVFFRKKSLDNKFPTHPAGTPIKNKNKQNPKKESVFEIDLIKNKRYTEDKFLFHVPITMNFKSGKIGSLNSKVLEYIKEADDLHIIGIDRGERNLLYVVVIDKNGNICEQVSLNQIGNVNYHNLIDEREGNRQKQRENWKTIEGIKDLKQGYLSQAVRIIADLMVKYKAIVVLENLNLGFMRGRQKVEKSVYQQFEKMLIEKLNYLVDKKAAPNLPGGALKAYQLANKFESFRAIGRQCGFLFYIPAWNTSKIDPATGFVNMLNPRYESIEKSKDYIGKFDAIRYNADKDYFEFDIDYSEFTVRAEGTKLKWTLCSYGTRIENYVDSQSGKWASRTVILTDEFKRAFKDLDINGDLKGQILSQSEKSFFEDLFRVLRLLVQLRNSEIQEHGESVKEPEDYILSPVANSEGVFFDSRKADDSMPKDADANGAYNIARKGLMIVNQVKQEKDLDKFKSDLTNKNWLNFAQEGK

SEQ ID NO: 20 - protein, 1125 aa, unidentified
GTPEQFAAVQSFNKFTSYFVGFNTVRENLYSDEDKASTIATRIVEENFTKFYNACRQYSLAKQTYPDAVIKTEKLLQQNLDQYFEIDAYNNYLSQSGIEQFNAILGGWVDIDGNKIQGLNECLNEAYQQDINKTKRIHLEPLYKQILSDREGKSFYIEAFKDDKQMAETIIDYTKAIRSTLNEETGEIYSPLSKLSNLFLHIENYDLSKIYVKKQNYTKLSQKMFGSWSVIPDCIARVAEEAIGPCEGMKKKDRQSWGKAFLSLSDIESVLAACSVECKWDVLGKTALELMRAIDFKQDGLYSVLKDATTTSYLQQKRRALGTIKNYLDAVQDYYHLVILFSSDQNLDCDTDFYYEYLECLKVLSAIKPLYNKTRNRLSKKPYSDEKFKLNFDSPVLADGWDISQERTKLTIILRKNGKYYLGILAVGAKPDKDALKDNPSADDYYEKMEYKLIPNPFMQLPKIAFSKKGLETYKPSESLVEGYKAKKHIKSNVNFDLSFCHELIDFFKTVCLSNPDWSVFDFKFSPTRNYRDISEFYREVETSGYSIKFAKVATSEIDELVENGNLYLFQIYNSDYALGHHGAFNLHTLYFENLFSKANLKDSRLKLSGGAEVFYRFASITNPTTHEVGEKVVNRWITLPNGIKTPLPESVHGEIYRFANGKLDKDKLSDQARKYLDTGNVVIKDVKQRIIKDRRFTEDKFFLHLPITINFASDNNNYLNYAVCEYLYDNPDVNIIGIDRGERCMLHATVINQKGEILEQRNLNVIDGYDYHAKLVERAKERDEQRKSWQSVDGIKNLKNGYISQAVKIVTDLMIEYNAIVVMEDLNTNFKRNRACIDTQTYQKFEKMLIDKLNYLVVSKDPDNVDENGKTLRGYQLANKFESFEMLGKQSGFIFYVSPWHTQTIDPSTGFINLFPYKELNYSNEKAAKNFFSKFEKISFNEKKNYFEFAFDYSKFETPYNPTQLLWTACSTSEERSNYVQKNGRWVPEKIDVNKRLKDLFEQADINYKNGNDLIEAIQDMSVPQVKELLMLFKTLMMLHYRTNDKDYVVSPVANEKGEFFSTTSNSEIHDADSVSSYCVALKGLQYATEEIVFNEEKERYQLAFSQKQNELWLNWMQTKPYLS

SEQ ID NO: 21 - protein, 1261 aa, unidentified
MSNFNEFTHLYQLSKTLRFELKPIGETLKHFNESGILDQDEHRAESYKKVKKLIDRYHKEFMEEALRDFVFQMDDEGKNNSLSEYFFLYSLGKRTEAQDNDFKEIKKNLREQIAKYFKASPKYKNLFKQELIKEDLCNNMQCNEEEQKLVEEFHNFTTYFTGFHENRKNMYSNEEKSTAIAFRLVHQNLPKFIDNIGAFDRARNIDEIKAGIKNLQKHFETKGLLKQGEKIEDFFALDYYSRLAVQSRIDIYNAILGGRATEKGEKIQGLNEYINLYNQQHKEARLPKMKALFKQILSDRQAISWIEESFKSDNEVLSSVNDFYENLKQNEIFDRTKELLTSVGSYDLSKVYITNDQQLTSISQQLYGSWAVIENAILADMQKDIPRKKKEDSEKYNERLKKAYSNKGSFSIAYIDQCLEAVFGEKHIPVEQHFTKRGEAEIETEAECGKIKIPDVFTQIEQTYSAAKTLLCNPYPKGKHLSQSDEDIEKVKNLLDALKRFQHFIKPLTGSGDEAEKDEMFYSDLTELWAEIDQLNSLYNRVRNHLTGKPYSEEKLKLNFENASLLTGWDKNMERANTAVILRKGKLYYLAIMKKEHNSIFASDNLPDKGECYEKMVYKQIALPLGFGGFARKCFGSATKLGWTYPTNLLNKEGKIIIKDEEAKDVLPELIDCYKDFLNIYEKDGFKYSSYNFKFKPSNQYEKLSQFFAEIQQQGYKITFQNISSDYIDQLVNEGKLYLFQIYNKDFSPSSKGTPNMHTLYWQMLFDERNLNDGVYQLNGQAEVFFRKKSLNYTKPTHPANQAIANKNPFKKKDKSEFTYDLIKDKRFTMDKFLFHVPITINFKSSKTYDIDAKVRQWLQKADDVHIIGIDRGERHLLYLTVIDCKGNIKEQMSLNTIENEYKGNTYAFDYHKRLDEKEKERDEARKNWKTVENIKELKEGYLSQAIHKITQLMLKYNAIIVLEDLNMGFMSGRQKVEKQVYQKFEKMLIDKLNYLADKKKDPSEVGGVLNAYQLTSKFESFTKLGRQSGFLFYIPAWNTSKIDPVTGFVNLFDTRYKNIDEAKKFFGSFKSISYNKDKNWFEFSFDYNDFTNKAEGTKTQWTVCTNGERIENFRSGENLNQWSGRKIVLSQEFKTLFDRYGIDFTKDLQNDICSQSDTGFFEQLLRLFKLTLQMRNSISNTETDYLISPVYDRNGNFYDSRNNRKDLPNNADANGAYNIARKGLMILNQIKQTSDLKKPKYDLTNKAWLNFIQKGYANKD

SEQ ID NO: 22 - protein, 1264 aa, unidentified
MNFEQFTHLYPLSKTLRFELRPVGATLARIKEGGFLENDNHRAESYKKVKKLIDEYHKHFIEQALGDFSLTENETEGSKCLNSYLETYIQLYRSSRIEDAEKKAFEKVQAEMRKLIAKTLKGSEAYKRLFKQELIKEDLTAFLRTHGGTVADEELVEEFKNFTTYFTGFYENRENMYSEEEKSTAISNRLVNENLPKFVDNMAAFAIIAQVPEVRAMLDVMQKDLGAELDGTTIDELFTLPFFNKVLTQKQIAVYNAVIGGKVRDSHSKGESHIKGINQIVNLYNQQHKDARLPKLKMLYKQILSDREALSWLPEKFDKDADLLKAIHDGYERLASDGVLENLRTLLESMADYQAEGIFITNDQQLTRISQKMFGEWSFISEAILCVLKKEVPQKRNECDEKYEERIDKMLKNHGGFSIRFIDDCVAAYVNTLDDEEQKKRFIPTVEAYFATLGAFDTEEEQTVNFFSRIQNARDALQGLLDSAYPEGRALIQDKENGALLKELLDAILALMHFVKPLLGKNENGKDERFYGELMQIWDEFDSFVPLYNMSRNYLTQKPYSEEKYKLNFENSQLLKGWDLNKEADNTSIILRKDGLFYLAIMNKKHNKLFARELPADGDCYDKMDYKLLPGPNKMFPKVFFSKSRIAEFAPSEHIMDVYRKGSFKKGDTFNLQDCHDLIDFFKASILKHEDWRQFEFKFSETEQYDDISGFYREVEAQGYKVTFRQVSVSYIDRLVNEGKLYLFQIYNKDFSSYSKGTPNMHTLYWRALFDERNLSDVVYKLNGEAEVFYRKKSIEAHPTHPANRPIKNKNKLNDKVESLFAYDLIKDRRYSEDKFSLHVPITMNFKSIGGPNINDDVVEFLRTNENLHFIGIDRGERHLLYLTVIDSHGHILEQRTLNDVVNNYQGKDYHTDYHDLLETRERQRQEARSSWKAIENIKDLKEGYLAQVVHQIAQLMVKYHAIVVLEDLNGGFMRGRQKVERSVYQQFEKKLIDKLNYLVDKKTDAHAPGGLMNAYQLANQFKSFKSMGRQSGFIFYIPAWNTSKIDPVTGFTNLFDTRYKNVHDAQQFFSMFKSIRYNETADRFEFRFSYSDFTRKAEGSRTDWTVCTYGTRIKTFRDPQKNNEWTSKEVVLTEEFKKFFASYGVDIHSNLKDSIAAHDEKAFFEQLLALMRLTLQIRNSKSGTDVDYLLSPVADENGVFFDSRSCGNSLPQDADANGAYNIARKGLMLVRQMREAKDLKKFKADMTNRNWLKFAQEKPYLND

SEQ ID NO: 23 - protein, 1269 aa, unidentified
MKQYEDFTGLYQISKTLRFEARPIGKTYENILKNGLIDRDEHRSRSYVQIKKLIDEYHKVFIDNALEDGCLCKETTGGSDVLNKYLELYLKNSKSDSDQKMLEKLQGLMRKAIAKRLSSQSGFKNMFNKELIQAYKVEGSKEKSEADLIKFVKGSKQECIASLTKEEAIDLINEFRGFTTYLKGYRENRKNLYSEEAKSTAIAYRLINENLPKFIDNIIAFRKIIEIPEMQEAMRTLCKEMEPYLNVKEIREMFSIDYYDMLLTQKQIDVYNAIIGGRVDETCDTHIKGINQYVNLYNQQHKETKLPKLKVLYKQILSDRNAISWLPEEFHNDKEVLDAIKDCYTRLTENILGEKVLKSLLTSLEEYDLNGIYIPNDQQLTDISQRIFGNWSEIQNAILGNIKEATPKKKKESDEAYSERLNALYKKQNSFSIHYINECLSAQGKEDGKTIQSYFGNCGAIDTPTTQRENLFLYISNMYTDAKCVLDRDFSNSLTQDKEAVEKIKNLLDSIKELQHFIKPLLGSGKETDKDERFSAEFDSIWRELDTITPLYNMVRNYMTRKPYSQDKIKLNFDNPQLLEGWDANKEQDYSSIILRRGANYYLAIMDKDSRKLLGKAMPSEGECYEKMVYKLLPGAKKMLPKVFFSKSRKEEFAPSQQIDEIRDNESYRKGSNFNIDDCHQLIDFYKQSILKHEDWSKFGFQFSPTSSYQDINEFFNEVEQQGYGISFTNVSIEYIDRLVDEGKLYLFQIYNKDFSEYSKGTPNMHTLYWRALFDEKNLADAIYKLNGKSELFYRRKSLERNEPTHPAHEPIKNKNKNNPKSESVFDYDLIKDKRYTLDKFMLHIPITMNFKCPDRINLNNQVKEYLQEAEDTHVIGIDRGERHLLYLVVIDRHGNIKEQFSLNDIVNEYNGINYRTDYHALLDRKEKERMEARKSWQTIESIKELKEGYLSQVIHKITQLMIKYHAIVVLEDLNRGFMRGRQKVEKEVYRKFEKMLIDKLNYLVDKRADPEAAGGLMKAYQLTSKFESFEKLGKQSGFLFYVPAWNTSKIDPVTGFVNLFDTHYKSIDSAKKFFSSFDSIRYEAEKGWFEFRFDYRNFGTKADGTRTEWTLCTRGSRIETFRNPDKNSQWDNQEIDLTSAIKSHLENYGIDVSSNLKDGICSQTDKSFFEGMLYYLKLTLQMRNSITGTSVDYLVSPISDENGNHFDSRTCGERLPQNADANGAYNIARKGLMLIDQIKQSDDVASLKFDISNKNWLKFAQEKPYLDD

SEQ ID NO: 24 - protein, 1249 aa, unidentified
MKEQFINRYPLSKTLRFSLIPVGETENNFNKNLLLAKDKQRAENYEKVKGYIDRFHKEYIESVLSKARIEKVDEYADLYWKSNKDDSNAKAMKSLENDMRKQISKQLKSNDRYKRLFGKELICEDLPAFLTDEDERETVECFRSFTTYFKGFNTNRENMYSSDEKSTAIAYRCINDNLPRFLDNVKRFQKVFNNLSYETITKLNTDLYNIFGRNIEDIFSVDYFEFVLAQSGIDIYNSMIGGYACSDKTKIQGLNECINLYNQQDAKNEKSKRLPLMKPLYKQILSEKDSVSFIPEKFNSDNEVLLAIEDYYNSHIGDIDLLTELLKSLNTYNADGIFVKSGVSITDISNGAFNSWNVLRSAWNEKYEALHPVTSKTEIDKYIEKRDKVYKAIKSFSLFELQNFGNENGNEITDWYISSISECNSKIKETYSQAQELLKSDYEKNYDKRLYKNEKATESVKNLLDAIKDFQHLAKPLNGTGKEENKDELFYGKFTSYYDSIADIDRLFDKVRNYITQKPYSKDKIKLNFDNPTFLNGWALGNESANSAQLLRDGDNYYLAIMDKELKNNIPKKYNSPTNEEDMLQKIIYQKAADSSKDIPNLLVIDGVTVKKNGRKEKTGIHAGENIILENLRNTYLPENINRIRKEKTFSTSSENFSEDDLCKYIQYYICRAQEFYSSYNFTFKNASEYKNYKEFLDDVKSQAYQISYDDISKKQIMELVDNGYIYLFQIYNKDFSNYSKGTPNLHTLYFKMLFDERNLSNVVYQLNCEAEMFYREASINDKEKITHNANQPIKNKNPDNEKKESVFEYDIIKDKRFTKRQFSLHVPITINFKAHGQKLLNYDVRKAIKYKDDNYVIGIDRGERNLIYISVINSNGEIVEQMSLNEIISDNEHRVDYQKLLDTKEKERDKARKNWTSVENIKELKEGYISQVVHKICQLVVKYDAVIAMEDLNFGFKRGRFPVEKQVYQKFENMLISKLNLLIDKKANPTEDGGLLRAYQLTKKFDGVNKAKQNGIIFYVPAWDTSKIDPVTGFVNLLKPKYTSVPEAKKLFETIDDIKYNANTDMFEFCIDYSKFPRCNSDFKKSWTVCTNSSRILTFRNKEKNNMWDNKQIVLTDEFKSLFNEFGIDYKGKLKNSILSISNADFYKRLIKLLSLTLQMRNSITGSTLPEDDYLISPVANENGEFYDSRNYKGTNAALPCDADANGAYNIARKALWAINVLKDTPDDMLNKTKLSITNAEWLKYTQR

SEQ ID NO: 25 - protein, 1245 aa, unidentified
METFSGFTNLYPLSKTLRFRLIPVGETLKYFIGSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 26 - protein, 1254 aa, unidentified
MTAMTDFTKLYNLSHTLTFELHPIGKTAEKLQESGLLNQDFKRSQDYAEVKSVLDEIHKKFLQEVLSDCDLSWQELADALKIFRINKDRRALEGIQKKYRKSLADKFSKNKFFKILTEATPSKLFRYLLDQPDMVERKVETFGKFACYFKGYQENRKNIYSAEEQQTAAAYRAVNVNFQKYLRVVELYGDFVKNFPELTEDIKQRTAELTKEDLSQVLQIENYNKFIAQSGIEYLNSLIAQINLSVNLYRQAHNVRLSFAPLLFKQILSDREQAFVVERIEKDDDLYEKLKAFCEQHICSVEIRGETGDLFSRLKGLFATLNDDSDLYVDAASLSGIGNVLTGNWSCFRDAMDAYANETLKSKILREKYCKQPVYSFSEIKSWRIVRTDDDGNTTPVRLTDYWNGKKVQEMFATEKTLRNRVLEMVRVSHDKNFRERNHDVALVKEYLDAVQGILHLLKPLNVGSENGGDLDLLGILTEFYDALSPIILLYNQVRNYVTQKPSDIGKIKLMFNNPTLADGWDFNKEKANTSVIFCRNGEYYLGVMNPKSKTDFDKLAVDDPANCYQKMVYKLLPGPNKMLPKVFFADKNIDFFAPSEDLLRRYEAKEHLKGEKFDLAYCHELINFFKESIARHKDWSKFGFKFSETSAYSGIDEFYREVAEQGYKMSFANIPVGTIDKLVEDGNLFLFQIWNKDFSEKSTGIPNKFTLYWKALFDRRNLSDVIFKLNGEAELFLREPAITEPVVHRPGEKLVNKTVVMEVGGDHQAIRNSIPDVVYTEIYKYVNGMEEGPLSSAAKEHLNKFPRLDWEPGMGLEATLKRTVVKDVKFQLVKDRRFAKRFFSFHVPITVNFKSPDPKGVRLNDRVWEFLKDNPDVNIIGIDRGERNLIYVNCIDQKGRILLQKSFNVVGGFDYHQKLDMREKERAQARKSWSEIGSIKELKSGYLSGVIYEIARMMIKYNAIVVMEDLNGGFKRSRTGIEKQVYQKFEKALIDKLNYLVFKNESGWSAPGGLLNGYQLTEHLESFSKLGRQCGWLFYVPAAYTSKIDPSTGFVSLFKLKNYTNSEKRKAFFENFKSIVYQAELDAFVFAFDYKKFKDVQSCWQSSWEVCSAKRRLVYSSRSQQTEEVNPTQLIKRALDKRDVALSDGFDLKHYISTVEAVDENAAFFKALLDAFGMTLQMRNSSKTEDYIESPVLNSKGVFFDSRKADENWPQDADSNGAYHIALKGLLCLKKGKVDLKLKDWFEFVQRRDFMVK

SEQ ID NO: 27 - protein, 1201 aa, unidentified
MKLEDFTNLYSLSKTLRFELRPIGKTRENIENGGLLRQDEDRAEKYVHIKKLIDEYHKAYIDKQLSGLVLQYADIGKANSLEEYYHSTRKSKDSDKDKIVKIQDNLRKQIVKRLKDSDEFKRIDKKELIQSDLAEFIKPAEDRALIAEFKNFTTYFTGFNENRQNMYSDKAISTAIAYRLIHENLPKFIDNIETFDRIAGITELYDQTSSDAEIFRLEHFSETLSQKQIDAYNSVMGRYNMLINEYNQTHKQSRLPKFKMLYKQILSDREHPSWLPEQFESDTAVLTAIRECYDDLRIPMANLKTLLEGLGNYDPSGIFLRNDQHLSQISKRLTGDRSSIERSVTEDLLTSRRLNKRKSRTTDEEESRKLFKQKGSLSIGYIADTAKIDVERYFAKLGAINTVTEQSENLFAKAENARTTADELLANDYPAGKRLVQSNDDIALLKNLLDALMELQWFVKPLLGTGDEAGKDERFYGEFAQIWEQLDRITPLYNMVRNYVTRKPYSTDKFKLNFESAALLGGWDKNKEPDCLSVILRKDEQYYLGIINKNHKKIFENDILPCEGECYDKMVYKLLPGANKMLPKVFFSASRIAEFAPSDEVKRIYNDKTFQKGEKFDLNDCRTLIDFYKASIDKHEEWNKFGFEFSDTNNYEDISGFFREVDRQGYKMSFRPVAASYIETLVEEGKLYLFQIYNKDFSAYSKGTPNMHTLYWRMLFDERNLSDVVYQLNGGAELFFRRKSLQNGRPTHPANIPIKNKNSRNDKKESLFDYDLIKDRRYTVDKFQFHVPITLNFKSDGAGRINERVREYLRSADDVHVIGIDRGERNLLYLVVTDMDGNICEQFSLNEICNTDYHSLLDEREHKRMQERQSWQAIEGIKELKEGYLSQVVHRIATLMVKYRAIVVLEDLNFGFMRSRQKVEKSVYQKFEHMLIDKLNYLVDKKANPTTPGGLLKAYQLTDKFESFQKLGKQSGFLFYVPAWNTSKIDPATGFVNMLDLGYESIDKAKTLLCKFDSIRYNACKDWFEFALDYDKFGSKATGTRTKWTVCTYGQRIDTYRNKDSQWVSRDVDLTNELKSLFSEHGIDIYSNLKDAIVAQNDKEFFANMQRILKLTMQMRNSKTGTDTDYIVSPVADANGRFFDSRQADATMPKDADANGAYNIARKGIMLVQQIKQSDDLRTMKFDISNKSWLRFAQHTNQADE

SEQ ID NO: 28 - protein, 1321 aa, unidentified
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHENRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGTPTLLNGWDVNKETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFQLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 29 - protein, 1315 aa, unidentified
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWEARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLADGWSESKISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 30 - protein, 1315 aa, unidentified
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWEARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQKLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLADGWSESKISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 31 - protein, 1257 aa, unidentified
MKYTDFTGIYPVSKTLRFELIPQGSTVENMKREGILNNDMHRADSYKEMKKLIDEYHKVFIERCLSDFSLKYDDTGKHDSLEEYFFYYEQKRNDKTKKIFEDIQVALRKQISKRFTGDTAFKRLFKKELIKEDLPSFVKNDPVKTELIKEFSDFTTYFQEFHKNRKNMYTSDAKSTAIAYRIINENLPKFIDNINAFHIVAKVPEMQEHFKTIADELRSHLQVGDDIDKMFNLQFFNKVLTQSQLAVYNAVIGGKSEGNKKIQGINEYVNLYNQQHKKARLPMLKLLYKQILSDRVAISWLQDEFDNDQDMLDTIEAFYNKLDSNETGVLGEGKLKQILMGLDGYNLDGVFLRNDLQLSEVSQRLCGGWNIIKDAMISDLKRSVQKKKKETGADFEERVSKLFSAQNSFSIAYINQCLGQAGIRCKIQDYFACLGAKEGENEAETTPDIFDQIAEAYHGAAPILNARPSSHNLAQDIEKVKAIKALLDALKRLQRFVKPLLGRGDEGDKDSFFYGDFMPIWEVLDQLTPLYNKVRNRMTRKPYSQEKIKLNFENSTLLNGWDLNKEHDNTSVILRREGLYYLGIMNKNYNKIFDANNVETIGDCYEKMIYKLLPGPNKMLPKVFFSKSRVQEFSPSKKILEIWESKSFKKGDNFNLDDCHALIDFYKDSIAKHPDWNKFNFKFSDTQSYTNISDFYRDVNQQGYSLSFTKVSVDYVNRMVDEGKLYLFQIYNKDFSPQSKGTPNMHTLYWRMLFDERNLHNVIYKLNGEAEVFYRKASLRCDRPTHPAHQPITCKNENDSKRVCVFDYDIIKNRRYTVDKFMFHVPITINYKCTGSDNINQQVCDYLRSAGDDTHIIGIDRGERNLLYLVIIDQHGTIKEQFSLNEIVNEYKGNTYCTNYHTLLEEKEAGNKKARQDWQTIESIKELKEGYLSQVIHKISMLMQRYHAIVVLEDLNGSFMRSRQKVEKQVYQKFEHMLINKLNYLVNKQYDAAEPGGLLHALQLTSRMDSFKKLGKQSGFLFYIPAWNTSKIDPVTGFVNLFDTRYCNEAKAKEFFEKFDDISYNDERDWFEFSFDYRHFTNKPTGTRTQWTLCTQGTRVRTFRNPEKSNHWDNEEFDLTQAFKDLFNKYGIDIASGLKARIVNGQLTKETSAVKDFYESLLKLLKLTLQMRNSVTGTDIDYLVSPVADKDGIFFDSRTCGSLLPANADANGAFNIARKGLMLLRQIQQSSIDAEKIQLAPIKNEDWLEFAQEKPYL

SEQ ID NO: 32 - protein, 1205 aa, unidentified
MYYQGLTKLYPISKTIRNELIPVGKTLEHIRMNNILEADIQRKSDYERVKKLMDDYHKQLINESLQDVHLSYVEEAADLYLNASKDKDIVDKFSKCQDKLRKEIVNLLKSHENFPKIGNKEIIKLLQSLSDTEKDYNALDSFSKFYTYFTSYNEVRKNLYSDEEKSSTAAYRLINENLPKFLDNIKAYSIAKSAGVRAKELTEEEQDCLFMTETFERTLTQDGIDNYNELIGKLNFAINLYNQQNNKLKGFRKVPKMKELYKQILSEREASFVDEFVDDEALLTNVESFSAHIKEFLESDSLSRFAEVLEESGGEMVYIKNDTSKTTFSNIVFGSWNVIDERLAEEYDSANSKKKKDEKYYDKRHKELKKNKSYSVEKIVSLSTETEDVIGKYIEKLQADIIAIKETREVFEKVVLKEHDKNKSLRKNTKAIEAIKSFLDTIKDFERDIKLISGSEHEMEKNLAVYAEQENILSSIRNVDSLYNMSRNYLTQKPFSTEKFKLNFNRATLLNGWDKNKETDNLGILLVKEGKYYLGIMNTKANKSFVNPPKPKTDNVYHKVNYKLLPGPNKMLPKVFFAKSNLEYYKPSEDLLAKYQAGTHKKGENFSLEDCHSLISFFKDSLEKHPDWSEFGFKFSDTKKYDDLSGFYREVEKQGYKITYTDIDVEYIDSLVEKDELYLFQIYNKDFSPYSKGNYNLHTLYLTMLFDERNLRNVVYKLNGEAEVFYRPASIGKDELIIHKSGEEIKNKNPKRAIDKPTSTFEYDIVKDRRYTKDKFMLHIPVTMNFGVDETRRFNEVVNDAIRGDDKVRVIGIDRGERNLLYVVVVDSDGTILEQISLNSIINNEYSIETDYHKLLDEKEGDRDRARKNWTTIENIKELKEGYLSQVVNVIAKLVLKYDAIICLEDLNFGFKRGRQKVEKQVYQKFEKMLIDKLNYLVIDKSRSQENPEEVGHVLNALQLTSKFTSFKELGKQTGIIYYVPAYLTSKIDPTTGFANLFYVKYESVEKSKDFFNRFDSICFNKVAGYFEFSFDYKNFTDRACGMRSKWKVCTNGERIIKYRNEEKNSSFDDKVIVLTEEFKKLFNEYGIAFNDCMDLTDAINAIDDASFFRKLTKLFQQTLQMRNSSADGSRDYIISPVENDNGEFFNSEKCDKSKPKDADANGAFNIARKGLWVLEQLYNSSSGEKLNLAMTNAEWLEYAQQHTI

SEQ ID NO: 33 - protein, 1260 aa, unidentified
MNKNKTIFSETIGQTYVSKTLKNTIIPIGATQLNIERNGLITEDKIRSEKRQELKKIMDDYYRYFINNTLSGNLAKTIEWGELFRAIDNNYINNSDKTKNELKNIQKKKRTELNKLFKSNDDYKKMFNAKLLSDILPEFINKQKISNTEKEERLNTVNLFNKFTSSFTDFFINRENIFADDKSTSICYRIVNENAWIFYQNYLIYNKIKEDAEKEIITIENNNVDGLDGFTLNSIFNFDFYGMLMNQKGIRFYNDICGIVNAHMNLYCQKYKKKAAKYRLKRMHKQILSIDESTFEVPKMLESDKEVYDLVNGFLYKLNEKKVLDRIRKISEDVTSYDLNKIYVCEKNYENLSLFMCRNWSVLRDSIKAFYQENTTGSNAGKEKKIEKLMKEDKYRSLQNINELINKYNSNSIERKAEEYIVNINEKLENKELVQLTNKEDISLIEDEESGEELKRVLDLIMSINHWIKMFIIDEEVDKDMAFYTEIEDIYYELEPLKSIYDKVRNYITQKPYSKEKIKLNFGIPTLAKGWSKTKEYDNNAIILIRENKYYIGIFNAKNKPDKTVIEGHKKKNDSDYKKMVYMFLTKPRLMLPKVFLSKKGIATYKTSEYILDGYRKGKHNKSSKNFDVNYCRDLIDYFKDCINKRDEWKGYKFKFSETSTYEDINDFYKEIEKQAYTIQWTYIDEKDIDEMNEKGQLYLFQIYNKDFSEKSTGTKNLHTMYFENLFSEENLKNIVLKLDGNAEVFFRKSSIKQPIIHKKGSILVNKGYNEQKENEERKTIPDEVYTELYKYFNKIGKVKLSNEAKKLIDEDKVEYFTSDYDIVKDYRYTVDKYFLHLPIKINCNAENYSPVNDIALKNIAENNDMHIIGIDRGERNLIYVSVIDLHGNIIEQKNFNIINGVNYKEKLKQRESERDSARKNWKQIGKIKDIKEGYLSLVIHEITSLVLKYNAIIAMEDLNMGFKRGRFKVERQVYQKFENMLISKLNYLVDKNKAVNEEGGVLKGYQMTYIPKSLKELGRQCGYIFYVPAAYTSKIDPTTGFVSVFNYKEMDDEKFVTSFDSIKYDKNRQKFALKFDYTNFITHNVKLAKNEWTIYSNGTRKIRKYRNDKWNSPDNVNLTNEIIKLMEQYNIQYDNEQDILEQVETLETKNKNNFCKEMKKLVKYIVQMRNSLPDNDSIEYDEIISPVLNESGEFYNSEEKNKKLPLDADANGAYCIALKGLYEVKQIKNNWKKGEKFPRKTLKISHNDWFDFIQNKRYL

SEQ ID NO: 34 - protein, 1278 aa, unidentified
MSININKFSDECRKIDFFTDLYNIQKTLRFSLIPIGATADNFEFKGRLSKEKDLLDSAKRIKEYISKYLADESDICLSQPVKLKHLDEYYELYITKDRDEQKFKSVEEKLRKELADLLKEILKRLNKKILSDYLPEYLEDDEKALEDIANLSSFSTYFNSYYDNCKNMYTDKEQSTAIPYRCINDNLPKFIDNMKAYEKALEELKPSDLEELRNNFKGVYDTTVDDMFTLDYFNCVLSQSGIDSYNAIIGNDKVKGINEYINLHNQTAEQGHKVPNLKRLYKQIGSQKKTISFLPSKFESDNELLKAVYDFYNTGDAEKNFTALKDTITEFEKIFDNLSEYNLDGVFVRNDISLTNLSQSMFNDWSVFRNLWNDQYDKVNNPEKAKDIDKYNDKRHKVYKKSESFSINQLQELIATTLEEDINSKKITDYFSCDFHRVTTEVENKYQLVKDLLSSDYPKNKNLKTSEEDVALIKDFLDSVKSLESFVKILTGTGKESGKDELFYGSFTKWFDQLRYIDKLYDKVRNYITEKPYSLDKIKLSFDNPQFLGGWQHSKETDYSAQLFMKDGLYYLGVMDKETKREFKTQYNTPENDSDTMVKIEYNQIPNPGRVIQNLMLVDGKIVKKNGRKNADGVNAVLEELKNQYLPENINRIRKTESYKTTSNNFNKDDLKAYLEYYIARTKEYYCKYNFVFKSADEYGSFNEFVDDVNNQAYQITKVKVSEKQLLSLVEQGKLYLFKIYNKDFSEYSKGKKNLHTMYFQMLFDDRNLENLVYKLQGGAEMFYRPASIKKDSEFKHDANVEIIKRTCEDKVNDKDNPTDDEKAKYYSKFDYDIVKNKRFTKDQFSLHLTLAMNCNQPDHYWLNNDVRELLKKSNKNHIIGIDRGERNLIYVTIINSDGVIVDQINFNIIENSYNGKKYKTDYQKKLNQREEDRQKARKTWKTIETIKELKDGYISQVVHQICKLIVQYDAIVVMENLNGGFKRGRTKVEKQVYQKFETMLINKLNYYVDKGTDYKECGGLLKAYQLTNKFETFERIGKQSGIIFYVDPYLTSKIDPVTGFANLLYPKYETIPKTHNFISNIDDIRYNQSEDYFEFDIDYDKFPQGSYNYRKKWTICSYGNRIKYYKDSRNKTASVVVDITEKFKETFTNAGIDFVNDNIKEKLLLVNSKELLKSFMDTLKLTVQLRNSEINSDVDYIISPIKDRNGNFYYSENYKKSNNEVPSQPQDGDANGAYNIARKGLMIINKLKKADDVTNNELLKISKKEWLEFAQKGDLGE

SEQ ID NO: 35 - protein, 1562 aa, unidentified
MKATSIWDNFTRKYSVSKTLRFELRPVGKTEENIVKKEIIDAEWISGKNIPKGTDADRARDYKIVKKLLNQLHILFINQALSSENVKEFEKEDKKSKTFVAWSDLLATHFDNWIQYTRDKSNSTVLKSLEKSKKDLYSKLGKLLNSKANAWKAEFISYHKIKSPDNIKIRLSASNVQILFGNTSDPIQLLKYQIELDNIKFLKDDGSEYTTKELADLLSTFEKFGTYFSGFNQNRANVYDIDGEISTSIAYRLFNQNIEFFFQNIKRWEQFTSSIGHKEAKENLKLVQWDIQSKLKELDMEIVQPRFNLKFEKLLTPQSFIYLLNQEGIDAFNTVLGGIPAEVKAEKKQGVNELINLTRQKLNEDKRKFPSLQIMYKQIMSERKTNFIDQYEDDVEMLKEIQEFSNDWNEKKKRHSASSKEIKESAIAYIQREFHETFDSLEERATVKEDFYLSEKSIQNLSIDIFGGYNTIHNLWYTEVEGMLKSGERPLTRVEKEKLKKQEYISFAQIERLISKHSQQYLDSTPKEANDRSLFKEKWKKTFKNGFKVSEYTNLKLNELISEGETFQKIDQETGKETTIKIPGLFESYENAILVESIKNQSLGTNKKESVPSIKEYLDSCLRLSKFIESFLVNSKDLKEDQSLDGCSDFQNTLTQWLNEEFDVFILYNKVRNHVTKKPGNTDKIKINFDNATLLDGWDVDKEAANFGFLLKKADNYYLGIADSSFNQDLKYFNEGERLDEIEKNRKNLEKEESKNISKIDQEKVKKYKEVIDDLKAISNLNKGRYSKAFYKQSKFTTLIPKCTTQLNEVIEHFKKFDTDYRIENKKFAKPFIITKEVFLLNNTVYDTATKKFTLKIGEDEDTKGLKKFQIGYYRATDDKKGYESALRNWITFCIEFTKSYKSCLNYNYSSLKSVSEYKSLDEFYKDLNGIGYTIDFVDISEEYINKKINEGKLYLFQIYNKDFSEKSKGKENLHTTYWKLLFDSKNLEDVVIKLNGQAEVFFRPASIHEKEKITHFKNQEIQNKNPNAVKKTSKFEYDIIKDNRFTKNKFLFHCPITLNFKADGNPYVNNEVQENIAKNPNVNIIGIDRGEKHLLYFTVINQQGQILDAGSLNSIKSEYKDKNQQSVSFETPYHKILDKKESERKEARESWQEIENIKELKAGYLSHVVHQLSNLIVKYNAIVVLEDLNKGFKRGRFKVEKQVYQKFEKSLIEKLNYLVFKDRKESNEPGHHLNAYQLTNKFLSFERLGKQSGVLFYATASYTSKVDPVTGFMQNIYDPYHKEKTREFYKNFTKIVYNGNYFEFNYDLNSVKPDSEEKRYRTNWTVCSCVIRSEYDSNSKTQKTYNVNDQLVKLFEDAKIKIENGNDLKSTILEQDDKFIRDLHFYFIAIQKMRVVDSKIEKGEDSNDYIQSPVYPFYCSKEIQPNKKGFYELPSNGDSNGAYNIARKGIVILDKIRLRVQIEKLFEDGTKIDWQKLPNLISKVKDKKLLMTVFEEWAELTHQGEVQQGDLLGKKMSKKGEQFAEFIKGLNVTKEDWEIYTQNEKVVQKQIKTWKLFSNST

SEQ ID NO: 36 - protein, 1288 aa, unidentified
MVGNKISNSFDSFTGINALSKTLRNELIPSDYTKRHIAESDFIAADTNKNEDQYVAKEMMDDYYRDFISKVLDNLHDIEWKNLFELMHKAKIDKSDATSKELIKIQDMLRKKIGKKFSQDPEYKVMLSAGMITKILPKYILEKYETDREDRLEAIKRFYGFTVYFKEFWASRQNVFSDKAIASSISYRIIHENAKIYMDNLDAYNRIKQIACEEIEKIEEEAYDFLQGDQLDVVYTEEAYGRFISQSGIDLYNNICGVINAHMNLYCQSKKCSRSKFKMQKLHKQILCKAETGFEIPLGFQDDAQVINAINSFNALIKEKNIISRLRTIGKSISLYDVNKIYISSKAFENVSVYIDHKWDVIASSLYKYFSEIVKGNKDNREEKIQKEIKKVKSCSLGDLQRLVNSYYKIDSTCLEHEVTEFVTKIIDEIDNFQITDFKFNDKISLIQNEQIVMDIKTYLDKYMSIYHWMKSFVIDELVDKDMEFYSELDELNEDMSEIVNLYNKVRNYVTQKPYSQEKIKLNFGSPTLADGWSKSKEFDNNAIILIRDEKIYLAIFNPRNKPAKTVISGHDVCNSETDYKKMNYYLLPGASKTLPHVFIKSRLWNESHGIPDEILRGYELGKHLKSSVNFDVEFCWKLIDYYKECISCYPNYKAYNFKFADTESYNDISEFYREVECQGYKIDWTYISSEDVEQLDRDGQIYLFQIYNKDFAPNSKGMDNLHTKYLKNIFSEDNLKNIVIKLNGEAELFYRKSSVKKKVEHKKGTILVNKTYKVEDNTENSKEKRVIIESVPDDCYMELVDYWRNGGIGILSDKAVQYKDKVSHYEATMDIVKDRRYTVDKFFIHLPITINFKADGRININEKVLKYIAENDELHVIGIDRGERNLLYVSVINKKGKIVEQKSFNMIESYETVTNIVRRYNYKDKLVNKESARTDARKNWKEIGKIKEIKEGYLSQVIHEISKMVLKYNAIIVMEDLNYGFKRGRFRVERQVYQKFENMLISKLAYLVDKSRKADEPGGVLRGYQLTYIPDSLEKLGSQCGIIFYVPAAYTSKIDPLTGFVNVFNFREYSNFETKLDFVRSLDSIRYDTEKKLFSISFDYDNFKTHNTTLAKTKWVIYLRGERIKKEHTSYGWKDDVWNVESRIKDLFDSSHMKYDDGHNLIEDILELESSVQKKLINELIEIIRLTVQLRNSKSERYDRTEAEYDRIVSPVMDENGRFYDSENYIFNEETELPKDADANGAYCIALKGLYNVIAIKNNWKEGEKFNRKLLSLNNYNWFDFIQNRRF

SEQ ID NO: 37 - protein, 1027 aa, unidentified
MKEIKELTGLYSLTKTIGLELKPVGKTQQLIESKKLIEQDDQRAEDYKIVKDIIDRYHKDFIDKCLNSVEIKKEDLEEYVSLAENSNRNTKDFDEVKTKMRNQITEAFKKNHLFTGLFKKNLIKDYLPDFVSEEEKNVVNKFSKFTTYFDAFNNNRKNLYSGDAKSGTIAYRLIHENLPMFLDNIASFNKISETRVNEYFSSIEAEFTDTLNGKHLADLFQIDYFNNTLTQKKIDNYNYIVGAVNKAVNLYKQQHKNIRIPLLKKIHKMILSDRVTPSWLPERFESDEEMLTAIKATYESLKEVLVGDDDDSLRNLLLNIDNFDLEHIYIAKDSGLTSISQQIFGYYDTYTLAIKDQLQRKNPATKKQRENPNLYDERIDKLYKKEGSFSIAYLNRLVDTKEHITINEYYRLLGSYCREGGKSNDDFFKQIDGAYSAISYLFSAEHGEIAQSDSDTAVVQKLLEAYKGLQRFIKPLLGHGDEADKDNEFDVKLRKVWDELNIITPLYDKVRNWLSRKIYNPEKIKLYFENNGKLLSGWSDSQTEYDNGTQYGGYIFRKKNEIGEYDFYLGISADAKLFRRDKTICYEDGMYERLDYYNLKPNTLLGNSYIGNYGEDSNAVLSAFNDAVTKLHLEKKLVPKDNEKVPTYLKRLKQDYANFYQILMNDNNVVDAYKSMKQHILATLASLIRVPAAIELTTQTNLDIDKLIDEIINLPSESFGYFPVATAAIEEANNREKKPLFLFKMSNKDLSYAEKFSKGDRKSRGTENLHTMYLKALLGMTQNVFSIGSGMVFFRHNTEGLAETTARHKANEFIANKNKLNDKKKSIFDYEIVKNKRFTVDKYLFHLSLKLNYTQPNKFDINSKVREIIRNGGIKHIIGIDRGERNLIYLSLIDMEGNIVMQKSLNILKDDHNAKGTDYKGLLTEREGENKEARRNWKKIANIKDLKRGYLSQVVHIISKMMVEYNAIVVLEDLNPGFIRGRQKIERNVYEQFERMLIDKLNFYVDKHKDANETGGLLHALQLTSES

SEQ ID NO: 38 - protein, 1245 aa, unidentified
MQERKKISHLTHRNSVLKTIGMQLNPVGKTMDYFQAKQILENDEKLKEDYQKIKEIADRFYRNLNEDVLSKTGLDKLKDYAEIYYHCNTDADRKRLNKCASELRKEIVKNFKNRDEYNKLFDKRMIEIVLPKHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTSDGTKVKGINEYINLYNQQVSKRDKIPNLQILYKQILSESEKVSFIPPKFEDDNELLSAVSEFYANDETFDEMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENNEIREKSIVDYYKTSLMQLTDNLSDKYNEVAPLLNENYSNEKGLKNDDKSISLIKNFLDAIKEIEKFIKPLSETNITGEKNDLFYSQFTPLLDNISRIDILYDKVRNYVTQKPFSTDKIKLNFGNYQLLNGWDKDKEREYGAVLLCRDEKYYLAIIDKSNNRILENIDFQDCDESDCYEKIIYKLLPTPNKMLPKVFFAKKHKKLLSPSDEILKIRKNGTFKKGDKFSLDDCHKLIDFYKESFKKYPNWLIYNFKFKKTNEYNDIREFYNDVALQGYNISKMKIPTSFIDKLVDEGKIYLFQLYNKDFSPHSKGTPNLHTLYFKMLFDERNLEDVVYKLNGEAKMFYRPASIKYDKPTHPKNTPIKNKNTLNDKKASTFPYDLIKDKRYTKWQFSLHFSITMNFKAPDKAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKSDNVSTVEPVIHNDKWLKFVQENDMANN

SEQ ID NO: 39 - protein, 1274 aa, unidentified
MAKNFEDFKRLYSLSKTLRFEAKPIGATLDNIVKSDLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINDYINLYNQKHKDDKLPKLKALFKQILSDRNAISWLPEEFNSDQEVLNAIKDCYERLSENVLGDKVLKSMLGSLADYSLDGIFIRNDLQLTDISQKMFGNWSVIQNAIMQNIKHVAPARKHKESEEEYENRIAGIFKKADSFSISYIDACLNETDPNNAYFVENYFATLGAVDTPTMQRENLFALVQNAYTEITALLHSDYPTEKNLAQDKANVAKIKALLDAIKSLQHFVKPLLGKGDESDKDERFYGELASLWAELDTMTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYYNGTHKKGKNFNIQDCHNLIDYFKQSIDKHEDWSKFGFKFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFGYDLIKDRRYTVDKFLFHVPITMNFKSSGSENINQDVKAYLRHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASVSGGLLNAYQLTSKFDSFQKLGKQSGFLFYIPAWNTSKIDPVTGFVNLLDTRYQNVEKAKSFFSKFDAIRYNKDKEWFEFNLDYDKFGKKAEGTRTKWTLCTRGMRIDTFRNKEKNSQWDNQEVDLTAEMKSLLEHYYIDIHSNLKDAISAQTDKAFFTGLLHILKLTLQMRNSITGTETDYLVSPVVDENGIFYDSRSCGDELPENADANGAYNIARKGLMMIEQIKDAKDLDNLKFDISNKAWLNFAQQKPYKNG

SEQ ID NO: 40 - protein, 1245 aa, unidentified
MQEHKKISHLTHRNSVQKTIRMQLNPVGKTMDYFQAKQILENDEKLKEDYQKIKEIADRFYRNLNEDVLSKTGLDKLKDYAEIYYHCNTDADRKRLDECASELRKEIVKNFKNRDEYNKLFNKKMIEIVLPQHLKNEDEKEVVASFKNFTTYFTGFFTNRKNMYSDGEESTAIAYRCINENLPKHLDNVKAFEKAISKLSKNAVDDLDTTYSGLCGTNLYDVFTVDYFNFLLPQSGITEYNKIIGGYTTSDGTKVKGINEYINLYNQQVSKRYKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFNESYANEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIRKNGTFKKGDKFSLDDCHKLIDFYKESFKKYPNWLIYNFKFKKTNEYNDISEFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKRASTFPYDLIKDKRYTKWQFSLHFPITMNFKAPDRAMINDDVRNLLKSCNNNFIIGIDRGERNLLYVSIIDSNGAIIYQHSLNIIGNKFKGKTYETNYREKLETREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGMQSGFIFYVRPDFTSKIDPVTGFVNLLYPRYENIDKAKDMISRFDDIRYNAGEDFFEFDIDYDKFPKTASDYRKKWTICTNGERIEAFRNPASNNEWSYRTIILAEKFKELFDNNSINYRDSDNLKAEILSQTKGKFFEDFFKLLRLTLQMRNSNPETGEDRILSPVKDKNGNFYDSSKYDEKSNLPCDADANGAYNIARKGLWIVEQFKKSDNVSTVEPVIHNDKWLKFVQENDMANN

SEQ ID NO: 41 - protein, 1245 aa, unidentified
MQERKKISHLTHRNSVKKTIRMQLNPVGKTMDYFQAKQILENDEKLKENYQKIKEIADRFYRNLNEDVLSKTGLDKLKDYAEIYYHCNTDADRKRLNKCASELRKEIVKNFKNRDEYNKLFDKRMIEIVLPKHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTNDGTKVKGINEYINLYNQQVSKRDKIPNLQILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIRKKSIVDYYKTSLMQLTDNLSDKYNEAAPLLNENYSNEKGLKNDDKSISLIKNFLDAIKEIEKFIKPLSETNITGEKNDLFYSQFTPLLDNISRIDILYDKVRNYVTQKPFSTDKIKLNFGNYQLLNGWDKDKEREYGAVLLCKDEKYYLAIIDKSNNRILENIDFQDCDESDCYEKIIYKLLPTPNKMLPKVFFAKKHKKLLSPSDEILKIYKNGTFKKGDKFSLDDCHKLIDFYKESFKKYPKWLIYNFKFKKTNGYNDIREFYNDVALQGYNISKMKIPTSFIDKLVDEGKIYLFQLYNKDFSPHSKGTPNLHTLYFKMLFDERNLEDVVYRLNGEAEMFYRPASIKYDKPTHPKNTPIKNKNTLNDKRASTFPYDLIKDKRYTKWQFSLHFPITMNFKDPDKAMINDDVRNLLKSCNNNFIIGIDRGERNLLYVSVINSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYEKIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDKWLKFVQENDMANN

SEQ ID NO: 42 - protein, 1245 aa, unidentified
MQEHKKISHLTHRNSVQKTIRMQLNPVGKTMDYFQAKQILENDEKLKENYQKIKEIADRFYRNLNEDVLSKTRLDKLKDYTDIYYHCNTDADRKRLDECASELRKEIVKNFKNRDEYNKLFNKKMIEIVLPKHLKNEDEKEVVTSFKNFTTYFTGFFTNRKNMYSDGEESTAIAYRCINENLPKHLDNVKAFEKAISKLSKNAIDDLDTTYSGLCGTNLYDVFTVDYFNFLLPQSGITEYNKIIGGYTTNDGTKVKGINEYINLYNQQVSKRDKIPNLKILYKQILSESEKVSFIPPKFEDDNELLSAVSEFYANDETFDGMPLKKAIDETKLLFGNLDNPSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYNEAAPLLNENYSNEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIYKSGTFKTGDKFSLDDCHKLIDFYKESFKKYPNWLIYNFKFKKTNEYNDIREFYNDVALQGYNISKMKIPTSFIDKLVDEGKIYLFQLYNKDFSPHSKGTPNLHTLYFKMLFDERNLEDVVYRLNGEAEMFYRPASIKYDKPTHPKNTPIKNKNTLNDKKTSTFPYDLIKDKRYTKWQFSLHFPITMNFKAPDKAMINDDVRNLLKSCNNNFIIGIDRGERNLLYVSVIDSNGAIIYQHSLNIIGNKFKEKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGMQSGFIFYVRPDFTSKIDPVTGFVNLLYPQYENIDKAKDMISRFDEIRYNAGEDFFEFDIDYDEFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDQWLKFVQENDMANN

SEQ ID NO: 43 - protein, 1288 aa, unidentified
MVGNKISNSFDSFTGINALSKTLRNELIPSDYTKRHIAESDFIAADTNKNEDQYVAKEMMDDYYRDFISKVLDNLHDIEWKNLFELMHKAKIDKSDATSKELIKIQDMLRKKIGKKFSQDPEYKVMLSAGMITKILPKYILEKYETDREDRLEAIKRFYGFTVYFKEFWASRQNVFSDKAIASSISYRIIHENAKIYMDNLDAYNRIKQIACEEIEKIEEEAYVFLQGDQLDVVYTEEAYGRFISQSGIDLYNNICGVINAHMNLYCQSKKCSRSKFKMQKLHKQILCKAETGFEIPLGFQDDAQVINAINSFNALIKEKNIISRLRTIGKSISLYDVNKIYISSKAFENVSVYIDHKWDVIASSLYKYFSEIVKGNKDNREEKIQKEIKKVKSCSLGDLQRLVNSYYKIDSTCLEHEVTEFVTKIIDGIDNFQITDFKFNDKISLIQNEQIVMDIKTYLDKYMSIYHWMKSFVIDELVDKDMEFYSELDELNEDMSEIVNLYNKVRNYVTQKPYSQEKIKLNFGSPTLADGWSKSKEFDNNAIILIRDEKIYLAIFNPRNKPAKTVISGHDVCNSETDYKKMNYYLLPGASKTLPHVFIKSRLWNESHGIPDEILRGYELGKHLKSSVNFDVEFCWKLIDYYKECISCYPNYKAYNFKFADTESYNDISEFYREVECQGYKIDWTYISSEDVEQLDRDGQIYLFQIYNKDFAPNSKGMDNLHTKYLKNIFSEDNLKNIVIKLNGEAELFYRKSSVKKKVEHKKGTILVNKTYKVEDNTENSKEKRVIIESVPDDCYMELVDYWRNGGIGILSDKAVQYKDKVSHYEATMDIVKDRRYTVDKFFIHLPITINFKADGRININEKVLKYIAENDELHVIGIDRGERNLLYVSVINKKGKIVEQKSFNMIESYETVTNIVRRYNYKDKLVNKESARTDARKNWKEIGKIKEIKEGYLSQVIHEISKMVLKYNAIIVMEDLNYGFKRGRFRVERQVYQKFENMLISKLAYLVDKSRKADEPGGVLRGYQLTYIPDSLEKLGSQCGIIFYVPAAYTSKIDPLTGFVNVFNFREYSNFETKLDFVRSLDSIRYDTEKRLFSISFDYDNFKTHNTTLAKTKWVIYLRGERIKKEHTSYGWKDDVWNVESRIKDLFDSSHMKYDDGHNLIEDILELESSVQKKLINELIEIIRLTVQLRNSKSERYDRTEAEYDRIVSPVMDEKGRFYDSENYIFNEETELPKDADANGAYCIALKGLYNVIAIKNNWKEGEKFNRKLLSLNNYNWFDFIQNRRF

SEQ ID NO: 44 - protein, 1089 aa, unidentified
MQAIHQFCGQKNGYSRSITLRNRLIPIGKTEENIQKFLESDKNRADKYPGAKQLIDNLHRDFIAEVLSTHSFDWQPLADSIEKFQKTKDARDKKNLQTQQTNLRKQIAKAFSSSEKGKKLFSKELFTELLPEYIKGKVDEKANEEIVKEFDRFTTYFTGFYDNRKNMYSDEEQATAISFRLVNENFPKFLTNAKLFQEIKGKYPEIINDALKSLKNEKIDSYFEVNGFNACLTQQGIDAYNQVLGGTAAEAGQEKSKGLNECINLYKQQHSDVKIGKMSMLYKQILSDRDGSFIDAFEKDEDVFKAVQSYHEILISQLSEIEKLFVDAEYDLDKIIVPVKKLTEYSQVCTGRWNVVEESIRQNFIAKHGEPKKKKDEDALDKELKKDQSLLELKNILASAPSMEGINIVDYLNNDNLVKQTFSSVELEVKNLEEGFVTLIQKISYKDGSDLKQKDDDVEHIKIYLDCALNLYHYLELVDYRGEAEKDGDFYSTYEKVIERLSGILFLYNKVRNYVTKKIDTEKKFKLNFDSPTLANGWDANKESANNAIILRKNGKYYLGIFNPNDKPKIDNEATCDASDCYEKMVYKLLPGPNKMLPKVFFSKKGLETFNPPKEILEGYTKEQYKKGDTFDIIFCHKLIDWFKDAINQHPDWKKFNFKFSKTESYADISEFYREITEQGYKISFTKIAESEIQNLVDCGKLFLFQIYNKDYAENSCGSKNLHTLYWENLFSEENLKNTVLKLNGEAELFFRPQVIKEDKIIAHKKDSYLVNRIGKDGKRIPESFYQEIYKKANGIIDKISDEAKEFEKNAVVKKATHDIVKDRRFTQNVYQFHCPITMNFKAAELTGKKFNERVQELLAKDPTVKVIGIDRGERHLLYLSLINQKGEIELQKTLNLVELNRNGQTVQVDYQQKLTLKEKERDNARKNWKTINNIKEIKEGYLSAVVHEIAKMMVEHNAIVVMEELNYGFKRGRFPVERQVYQKFELALIEKLNFLVFKNKNVSEAGGVLNAFQLTQKPDSLTDFGKQNGWIFYIPAAYTSKIDPKTGFIDFFKLSKVATKNLTNMDAKKSFFKGSSSTCVGGFATLFC

SEQ ID NO: 45 - protein, 1245 aa, unidentified
MQEHKKISHLTHRNSVQKTIRMQLNPVGKTMDYFQAKQILENDEKLKEDYQKIKEIADRFYRNLNEDVLSKTGLDKLKDYADIYYHCNTDADRKRLNECASELRKEIVKNFKNRDEYNKLFNKKMIEIVLPKHLKNEDEKEVVASFKNFTTYFTGFFTNRKNMYSDGEESTAIAYRCINENLPKHLDNVKVFEKAISKLSKNAIDDLGATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFSENYDNEKGLKNDDKSISLIKNFLDAIKEIEKFIKPLSETNITGEKNDLFYSQFTPLLDNISRIDILYDKVRNYVTQKPFSTDKIKLNFGNSQLLNGWDKDKEREYGAVLLCKDEKYYLAIIDKSNNSILENIDFQDCNESDYYEKIVYKLLTKINGNLPRVFFSEKRKKLLSPSDEILKIYKSGTFKKGDKFSLDDCHKLIDFYKESFKKYPNWLIYNFKFKNTNEYNDISEFYNDVASQGYNISKMKIPTTFIDKLVDEGKIYLFQLYNKDFSPHSKGTPNLHTLYFKMLFDERNLEDVVYKLNGEAEMFYRPASIKYDKPTHPKNTPIKNKNTLNDKKASTFPYDLIKDKRYTKWQFSLHFPITMNFKAPDKAMINDDVRNLLKSCNNNFIIGIDRGERNLLYVSVIDSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDKWLKFVQENDMANN

SEQ ID NO: 46 - protein, 1273 aa, unidentified
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDKIKTKMRNQITEAFRKNSLFTNLFKKNLIKEYLPAFVSEEEKSVVNKFSKFTTYFDAFNDNRKNLYSGDAKSGTIAYRLIHENLPMFLDNIASFNAISGIGVNEYFSSIETEFTDTLEGKRLTEFFQIDFFNNTLTQKKIGNYNYIVGAVNKAVNLYKQQHKTVRVPLLKPLYKMILSDRVTPSWLPERFESDEEMLTAIKAAYESLREVLVGDNDESLRNLLLNIEHYDLEHIYIANDSGLTSISQKIFGCYDTYTLAIKDQLQRDYPATKKQREAPDLYDERIDKLYKKVGSFSIAYLNRLVDAKGHFTINEYYKQLGAYCREEGKEKDDFFKRIDGAYCAISHLFFGEHGEIAQSDSDVELIQKLLEAYKGLQRFIKPLLGHGDEADKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAISYDDGMYERLDYYQLKSKTLLGNSYVGDYGLDSMNLLSAFKNAAVKFQFEKEVVPKDKENVPKYLKRLKLDYAGFYQILMNDDKVVDAYKIMKQHILATLTSSIRVPAAIELATQKELGIDELIDEIMNLPSKSFGYFPIVTAAIEEANKRENKPLFLFKMSNKDLSYAATASKGLRKGRGTENLHSMYLKALLGMTQSVFDIGSGMVFFRHQTKGLAETTARHKANEFVANKNKLNDKKKSIFGYEIVKNKRFTVDKYLFKLSMNLNYSQPNNNKIDVNSKVREIISNGGIKNIIGIDRGERNLLYLSLIDLKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKGANETGGLLHALQLTSEFKNFKKSEHQNGCLFYIPAWNTSKIDPATGFVNLFNTKYTNAVEAQEFFSKFDEIRYNEEKDWFEFEFDYDKFTQKAHGTRTKWTLCTYGMRLRSFKNSAKQYNWDSEVVALTEEFKRILGEAGIDIHENLKDAICNLEGKSQKYLEPLMQFMKLLLQLRNSKAGTDEDYILSPVADENGIFYDSRSCGDQLPENADANGAYNIARKGLMLIEQIKNAEDLNNVKFDISNKAWLNFAQQKPYKNG

SEQ ID NO: 47 - protein, 1261 aa, unidentified
MNTSLFSSFTRQYPVTKTLRFELKPMGATLGHIQQKGFLHKDEELAKIYKKIKELLDEYHRAFIADTLGDAQLVGLDDFYADYQALKQDSKNSHLKDKLTKTQDNLRKQITKNFEKTPQLKERYKRLFTKELFKAGKDKGDLEKWLINHDSEPNKAEKISWIHQFENFTTYFQGFYENRKNMYSDEVKHTAIAYRLIHENLPRFVDNIQVLSKIKSDYPDLYHELNHLDSRTIDFADFKFDDMLQMDFYHHLLIQSGITAYNTLLGGKVLEGGKKLQGINELINLYGQKHKIKIAKLKPLHKQILSDGQSVSFLPKKFDNDYELCQTVNHFYREYVAIFDELVVLFQKFYDYDKDNIYINHQQLNQLSHELFADFRLLSRALDFYYCQIIDGDFNNKINNAKSQNAKEKLLKEKERYTKSNHSINELQKAINHYASHHEDTEVKVISDYFSATNIRNMIDGIHHHFSTIKGFLEKDNNQGESYLPKQKNSNDVKNLKLFLDGVLRLIHFIKPLALKSDDTLEKEEHFYGEFMPLYDKLVMFTLLYNKVRDYISQKPYNDEKIKLNFGNSTLLNGWDVNKEKDNFGVILCKEGLYYLAILDKSHKKVFDNAPKATSSHTYQKMVYKLLPGPNKMLPKVFFAKSNIGYYQPSAQLLENYEKGTHKKGSNFSLTDCHHLIDFFKSSIAKHPEWKEFGFRFSDTHTYQDLSDFYKEIEPQSYKVKFIDIDADYIDDLVEKGQLYLFQLYNKDFSKQSYGKPNLHTLYFKSLFSDDNLKNPIYKLNGEAEIFYRRASLSVSDTTIHQAGEILTPKNPNNTHNRTLSYDVIKNKRYTTDKFFLHIPITMNFGIENTGFKAFNHQVNTTLKNADKKDVHIIGIDRGERHLLYVSVIDGDGRIVEQRTLNDIVSISNNGMSMSTPYHQILDNREKERLAARTDWGDIKNIKELKAGYLSHVVHEVVQMMLKYNAMIVLEDLNFGFKHGRFKVEKQVYQNFENALIKKLNYLVLKNADNHQLGSVRKALQLTNNFTDIKSIGKQTGFIFYVPAWNTSKIDPTTGFVDLLKPRYENMAQAQSFISRFKKIAYNHQLDYFEFEFDYADFYQKTIDKKRIWTLCTYGDVRYYYDHKTKETKTVNITKELKSLLDKHDLSYQNGHNLVDELANSHDKSLLSGVMYLLKVLLALRYSHAQKNEDFILSPVMNKDGVFFDSRFADDVLPNNADANGAYHIALKGLWVLNQIQSADNMDKIDLSISNEQWLHFTQSR

SEQ ID NO: 48 - protein, 1252 aa, unidentified
MIDLKQFIGIYPVSKTLRFELRPVGKTQEWIEKNRVLEGDEQKAADYPVVKKLIDDYHKVCIHDSLNHVHFDWEPLKDAIEIFQKTKSDEAKKRLEAEQAMMRKKIAAAIKDFKHFKELTAATPSDLITSVLPEFSDDGSLKSFRGFATYFSGFQENRNNIYSQEAISTGVPYRLVHDNFPKFLSDLEVFERIKSTCPEVINQASAELQPFLEGVMIDDIFSLDFYNSLLTQNGIDFFNQVIGGVSEKDKQKYRGINEFSNLYRQQHKEIAASKKAMTMIPLFKQILSDRDTLSYIPAQIRTEDELVSSITQFYDHITHFEHDGKTINVLSEIVALLGKLDTYDPNGICITARKLTDISQKVYGKWSVIEEKMKEKAIQQYGDISVAKNKKKVDAFLSRKAYSLSDLCFDEEISFSRYYSELPQTLNAISGYWLQFNEWCKSDEKQKFLNNQTGTEVVKSLLDAMMELFHKCSVLVMPEEYEVDKSFYNEFLPLYEELDTLFLLYNKVRNYLTQKPSDVKKFKLNFESPSLASGWDQNKEMKNNAILLFKDGKSYLGVLNAKNKAKIKDAKGDVSSSSYKKMIYKLLSDPSKDLPHKIFAKGNLDFYKPSEYILEGRELGKYKKGPNFDKKFLHDFIDFYKAAISIDPDWSKFNFQYSPTESYDDIGMFFSEIKKQAYKIRFTDISEAQVNEWVDNGQLYLFQLYNKDYAEGAHGRKNLHTLYWENLFTDENLSNLVLKLNGQAELFCRPQSIKKPVSHKIGSKMLNRRDKSGMPIPESIYRSLYQYYNGKKKESELTVAEKQYIDQVIVKDVTHEIIKDRRYTRQEYFFHVPLTFNANADGNEYINEHVLNYLKDNPDVNIIGIDRGERHLIYLTLINQRGEILKQKTFNVVNSYNYQAKLEQREKERDEARKSWDSVGKIKDLKEGFLSAVIHEITNMMIENNAIVVLEDLNFGFKRGRFKVERQVYQKFEKMLIDKLNYLSFKDREAGEEGGILRGYQMAQKFISFQRLGKQSGFLFYIPAAYTSKIDPVSGFVNHFNFSDITNAEKRKDFLMKMDRIEMKNGNIEFTFDYRKFKTFQTDYQNVWTVSTFGKRIVMRIDEKGYKKMVDYEPTNDIIKAFKNKGILLSEGSDLKALIAEIEANATNAGFYSTLLYAFQKTLQMRNSNAVTEEDYILSPVAKDGHQFCSTDEANKGKDAQGNWVSKLPVDADANGAYHIALKGLYLLRNPETKKIENEKWLQFMVEKPYLE

SEQ ID NO: 49 - protein, 1251 aa, unidentified
MKKSSLQDFTNQYSLSKTLRFELIPQGETLEHIEKNGLLSQDEHRAESYIIVKKIIDEYHKAFITKALDGVKLNSLEDYFLYYQLPKRDEEQKKKFEEIQTKLRKQIADRFAKQESFKNLFAKELIKDDLINFVKSNDDKLLVAEFQNFTTYFTGFHENRKNMYSAEDKSTAIAFRLIHQNLPKFIDNMRAFDKIKISKVKDSFKTILADDELGAIIQVIAVEDVFTLNYFNDTLTQLGIDKYNQLIGGFTSEDGKIKIKGLNEYINLYNQTAKKEERLPKLKPLYKQILSDRSTASFIPEAFSNDNEVLESIEKLYQEINDLVLNKRVKGEHSLKELLQSLNEYDVSKVYLRNDLSLTDISQKMFGDWGVFQKGMQTWYAVNYKGKNKAGTEKYEDEQKKYFSNQDSYSIGFINECLLLLDTVYQKRIEDYFKLLGERNTEEEKSENLFVLIEKNYNGIKDLLNNPYPHDKNLAQDQANVDKIKNFLDVVKTLQWFIKPLLGKGNEAEKDERFYGEFTSLWTTLDQVTPLYNKVRNYMTQKPYSTEKIKLNFENSTLLDGWDVNKEVDNTAMIFRKNGLYYLGIMNKKHNKIFKTDIANTGGECYEKMEYKLLPGANKMLPKVFFSNSRIDEFKPGTELLENYKNETHKKGDNFNLNDCHHLIDFFKTSINKHEDWKHFGFQFSDTKTYNDLSGFYREVEQQGYKITYKAISENYIAQMIAEGKLYLFQIYNKDFSPYSKGMPNMHTLYWKMLFDAVNLKNVVYKLNGQAEVFYRKLSIKAENIITHKANVPIHNKNEENEKKQQSRFDYDIIKDKRYTMDKFQFHVPITMNFKAKGLNNINIEVNQYLKKESDIHIIGIDRGERHLLYLTLIDGKGNIKQQFSLNEIINEYQGKTYKTNYHDLLDKKEGDRDDARRNWKTIETIKELKEGYLSQVIHKISELMVEHNAIVVLEDLNMGFMRGRQKVEKQVYQKFEKMLIDKLNYLVDKKKNPTDLGGTLNAYQLTNKFESFQKMGKQSGFLFYVPAWNTSKMDPVTGFVNLLDTRYENIEKAKTFFSKFDSIHYNPLKKYVEFECDYNRFTTKAEGTQTKWTLCTYKERIETFRDPTQNSQWKSREIVLTDEFISLFEQYGIAYKNKEELKDAIARQTEKVFFERLLHLLKLTLQMRNSITGTETDYLISPVANAKGEFYDSRTASETLPKNADANGAYNIARKGLWVVEQIKQADDLKKLKLAISNKEWLGFVQNYGK

SEQ ID NO: 50 - protein, 1292 aa, unidentified
MKNLTDFTGLYPLSKTLRFELIPQGKTLEYVVSNGLLEKDEHRAESYVLVKRIIDEYHKFFIAGALDNFKLDSLEEYYLYYQIIKRNDDEKKKFEDIQLKLRKQIAEQFTKSEGYKNLFAKELIKEDLKTFVQTIEDRQLIEEFQNFTTYFTGFHENRKNMYSAEDKSTAIAFRIIHQNLPKFLDNMRVFEKIAVSPINEKFPKLLTDLAHILQVENIEDMFNLNYFNETLTQRGIDVYNHLLSGYADEGKVKIQGLNEYINEFNQPLQKNQRIGKLKPLFKQILSDRSTASFIPEEFDNDNEVLESIEKLYQEINAYALPQLIVLLQNLKEYDVHKIYLRNDLGFTDISQKMFGDWGVFQKAVAKWFDINYKGKAKQGTEKFEDEQKKYFSSQDSYTIGFINDSLALLENPIYHLKVEDYLRLLGEPKGEGEKLNNLFKQVELNYLMVQDLLNNPYSTEKNLAQDQRQVDKLKLLLDSIKSLQWYVKPLLGKGNESDKDERFYGEFSGLWDTLDQITPLYNKVRNYMTRKPYSTEKMKLNFENSTLLDGWDVNKEEANASILFEKNGCYYLGIMDKNHNKIFRKIPTSKTNDTYQKINYKLLPGASKMLPKVFFSNSNIGYYNPTDEILSIRNHGSHTKNGKPQDGFEKKNFSIDDCKRMIDFFKKSIDKHEDWKNFGFIFSDTNSYQSIDEFYREVEGQGYSITYTNIDAEYINQMVDEGKLYLFQIYNKDFSPYSKGTPNMHTLYWKMLFDPQNLNDVVYKLNGQAEVFYRKSSIKDENMIIHRNQYKIAKKTYINQDREAVRIEEKVVASLNSYYQGKLSKDQLSKDELKYIDNYSDFKEKNIDITKDKRYTVDKFQFHVPITMNFKAPSLNNINTEVNNYLKTSQNQHVIGIDRGERHLLYLTLIDGEGRIVKQFSLNEIVNEYQGNIYKTNYHTLLDKKEGNRDEARKNWKTIETIKELKEGYLSQVIHKISELMVEYNAIVVLEDLNMGFMRGRQKVEKQVYQKFEKMLIDKLNYLVDKKKTSAEAGGTLHALQFTNKFESFQKMGKQSGFLFYVPAWNTSKMDPVTGFVNLFDTRYENMEKAKAFFNKFDTIHYNKANNRFEFAFDYNRFTTKAEGTKTNWTLCTNSDRIETFRNPDKNNKWDNREINITDEFHKLFASVASIETQNFASLPNEPNAIKQLILKQTEKSFFERLFYLLKLTLQMRNSKTDTEIDYLISPVANEKGQFYDSRNGIESLPTDADANGAYNIARKGLWAIEQIRKTDDLKKLKLAITNKEWLAFVQR

SEQ ID NO: 51 - protein, 1290 aa, unidentified
MESPTTQLKKFTNLYQLSKTLRFELKPVGKTKEHIETKGILKKDEERAVNYKLIKKIIDGFHKHFIELAMQQVKLSKLDELAELYNASAERKKEESYKKELEQVQAALRKEIVKGFNIGEAKEIFSKIDKKELFTELLDEWVKNLEEKKLVDDFKTFTTYFTGFHENRKNMYTDKAQSTAIAYRLVHENLPKFLDNTKIFKQIETKFEASKIEEIETKLEPIIQGTSLSEIFTLDYYNHALTQAGIDFINNIIGGYTEDEGKKKIQGLNEYINLYNQKQEKKNRIPKLKILYKQILSDRDSISFLPDAFEDSQEVLNAIQNYYQTNLIDFKPKDKEETENVLEETKKLLTELFSNELSKIYIRNDKAITDISQALFNDWGVFKSALEYKFIQDLELGTKELSKKQENEKEKYLKQAYFSIAEIENALFAYQNETDVLNEIKENSHPIADYFTKHFKAKKKVDTSTSSVEKDFDLIANIDAKYSCIKGILNTDYPKDKKLNQEKKTIDDLKVFLDSLMELLHFVKPLALPNDSILEKDENFYSHFESYYEQLELLIPLYNKVRNYAAKKPYSTEKFKLNFENATLLKGWDKNKEIDNTSVILRKRGLYYLAIMPQDNKNVFKKSPNLKNNESCFEKMDYKQMALPMGFGAFVRKCFGTAFQLGWNCPKSCINEEDKIIIKEDEVKNNRAEIIDCYKDFLNIYEKDGFQYKEYGFNFKESKEYESLREFFIDVEQKGYKIEFQNISENYIHQLVNEGKLYLFQIYNKDFSSYSKGKPNMHTMYWKALFDPENLKDVVYKLNGQAEVFYRKKSIEDKNIITHKANEPIENKNPKAKKTQSTFEYDLIKDKRYTVDKFHFHVPITINFKATGNNYINQQVLDHLKNNTDVNIIGLDRGERHLIYLTLINQKGEILLQESLNTIVNKKFDIETPYHTLLQNKEDERAKARENWGVIENIKELKEGYLSQVVHKIAKLMVDYNAIVVMEDLNTGFKRGRFKVEKQVYQKLEKMLIDKLNYLVFKDKDPNEVGGLYNALQLTNKFESFSKMGKQSGFLFYVPAWNTSKIDPTTGFVNLFYAKYESIPKAQDFFTKFKSIRYNSDENYFEFAFDYNDFTTRAEGTKSDWTVCTYGDRIKTFRNPEKNNQWDNQEVNLIEQFEAFFGKHNITYGDGNCIKKQLIEQDKKEFFEELFHLFKLTLQMRNSITNSEIDYLISPVKNSKKEFYDSRKADSTLPKDADANGAYHIAKKGLMWLEKINSFKGSDWKKLDLDKTNKTWLNFVQETASEKHKKLQTV

SEQ ID NO: 52 - protein, 1313 aa, unidentified
MSKLHFATLLTGAIMGVVRIDDKLKKLFWDLYSLRKTLRFELKPQGKTLEHIENKGLISQDEQRAESYKKMKKTINGFHKHFIEIAMSQVKLTKLNEFADLYNASPERKKEDGFKKAFEKIQADLRKDIAKAFNVGEAKEIFSKIDKKELVTELLEKWIRTQEEDLYFDERFKTFTTYFGGFHENRKNMYSDKEQSTAIAYRLIHENLPKFLDNIKVFERIKEISELYKNFPALYKEIKEYLDIEQIDEAFELYYYNKILTQKQIDAYNLIIGGMTAQEGKKKIQGLNEYINLYNQKQDKKDRIPTLKQLYKQILSDKESVSFLPDEFEDDAEETASQKVLNAIEEYYQANLVSFHPSGKDEAENVLEKIKELLTSLKDYDLNKIYLRNDKAITDISKTLFGDWNIIKAALEFAFLQTLETGKKGLSKKQEKEKEKYLEQSYFSIAEIEKALFAYKNEAEVLKDLKENTTPIADYFHTHFLAKKKEESDKEFDMIANIQAKYSCIKGILNTDYPKENRLHQDKKTIGDIKAFLDSLMELLHFVKQISLPSDTPLEKDEIFYSQFQPWYDQLQLLIPLYNKVRNYASQKPYSIEKFKLNFQSSTLAQGWDLNKEHNKNYSLIFKENDSFFLGIINIDDDKDVLRKDKRPEIFVDDSPLKKMVYKDLGDIKRQLPRIAFSDKAKKDVEDIGWNQNIEAIKKEFDKFQDAKKNDKDLWKNEFDRNKLSELIDYYKGVLKNHSERYEDTYKLEYKSTESYKNLGEFFDHIASQTYKVTFVGIDKNYINQLVDQGKLYLFQIYNKDFSKYSKGKPNLHTLYWKALFDPENLKNVMYKLNGGAELFYRKKSIKDLTIHKSNEPIKNKNPNNPKKESFFEYDIVKDRRYSVDKFQFHVPITLNFKATEKKYINNTVLGFLKDNPDVNIIGIDRGERHLLYLTLIDQKGKILEQRSLNTIVNNRVNIKTDYHKLLHNREKERDKARKDWGTIETIKELKDGYISIIVHEISRMMVEHNAIVVMEDLNFGFKRGRFKVEKQIYQKFEKKLIDKLNYLVFKDKANNETGGLYKALQLTSKFESFTKLGKQSGFLFYVPAWNTSKIDPTTGFVNLFNTRYENVDKAKTFFNNFENIRYNTDKDNFEFEVKKYSLFNSKVDDTIQDWVICTHGERIKTFRNSEKNNQWDNKEIVLTEEFKNLFKEYNINYKRDLKNQINSQTNKDFFEQLLNLFKYTVQMRNSITNSETDYLISPVINSEGKFYDSRNAGDELPKDADANGAYHIAKKGLWVLQQINAHEGEDWKKLKLAISNKEWLQFVQARAK

SEQ ID NO: 53 - protein, 1297 aa, unidentified
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHKNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQSSTLAQGWDLNKEHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFHFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 54 - protein, 1245 aa, unidentified
MQEHKKISHLTHRNSVQKTIRMQLNPVGKTMDYFQAKQILENDEKLKENYQKIKEIADRFYRNLNEDVLSKTMLDKLKDYAEIYYHCNTDADRKRLDECASELRKEIVKNFKNRDEYNKLFNKKMIEIVLPEHLKNEDEKEVVASFKNFTTYFTGFFTNRKNMYSDGEESTAIAYRCINENLPKHLDNVKAFEKAISKLSKNAIDDLDATYSGLCGINLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFSENYDNEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDKSDCYEKIIYKLLPGPNKMLPKVFFSEKCKKLLSPSDEILKIRKNGTFKKGDKFSLDDCHKLIDFYKESFKKYPNWLIYNFKFKNTNEYNDISEFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKKASTFPYDLIKDKRYTKWQFSLHFPITMNFKAPDKAMINDDVRNLLKSCNNNFIIGIDRGERNLLYVSVIDSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDDIRYNAGEDFFEFDIDYDKFPKTASDYRKKWTICTNGERIEAFRNPASNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDKWLKFVQENYMANN

SEQ ID NO: 55 - protein, 1245 aa, unidentified
MQERKKISHLTHRNSVQKTIRMQLNPVGKTMDYFQAKQILENDEKLKENYQKIKEIADRFYRNLNEDVLSKTGLDKLKDYAEIYYHCNTDAERKRLDECASELRKEIVKNFKNRDEYNKLFNKKMIEIVLPQHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVNYYKTSLMQLTDNLSDKYNEAAPLLNKSYANEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCRDEKYYLAIIDKSNNSILENIDFQDCDENDCYEKIIYKLLPGPNKMLPKVFFSEKCKKLLSPSDEILKIRKNGTFKKGDKFSLDDCHKLIDFYKESFKKYPNWLIYNFKFKNTNEYNDIREFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKKTSTFPYDLIKDKRYTKWQFSLHFPITMNFKAPDRAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEGGGLLHAYQLTNKLESFDKLGMQSGFIFYVRPDFTSKIDPVTGFVNLLYPRYENIDKAKDMISRFDDIGYNAGEDFFEFDIDYDKFPKTASDYRKRWTICTNGERIEAFRNPAKNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKSDNVSTVGPVIHNDKWLKFVQENDMANN

SEQ ID NO: 56 - protein, 1245 aa, unidentified
MQERKKISHLTHRNSVKKTIRMQLNPVGKTMDYFQAKQILENDEKLKENYQKIKEIADRFYRNLNEDVLSKTGLDKLKDYAEIYYHCNTDADRKRLNKCASELRKEIVKNFKNKDEYNKLFDKRMIEIVLPKHLKNEDEKEVVASFKNFTTYFTGFFTNRKNMYSDGEESTAIAYRCINENLPKHLDNVKAFEKAISKLSKNAIDDLNATYSGLCGTNLYDAFTVDYFNFMLSQSGITEYNKIIGGYTTSDGTKVKGINEYINLYNQQVSKRDKIPNLKILYKQILSESEKVSFIPPKFEDDNELLSTVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFNESYANEKGLKNDDKSISLIKNFLDAIKEIEKFIKPLSETNITGEKNDLFYSQFTPLLDNISRIDILYDKVRNYVTQKPFSTDKIKLNFGNYQLLNGWDKDKEREYGAVLLCRDEKYYLAIIDKSNNRILENIDFQDCDESDCYEKIIYKLLPTPNKMLPKVFFAKKHKKLLSPSDEILKIYKNGTFKKGDKFSLDDCHKLIDFYKESFKKYPKWLIYNFKFKKTNEYNDIREFYNDVALQGYNISKMKIPTSFIDKLVDEGKIYLFQLYNKDFSPHSKGTPNLHTLYFKMLFDERNLEDVVYRLNGEAEMFYRPASIKYDKPTHPKNTPIKNKNTLNDKKASTFPYDLIKDKRYTKWQFSLHFPITMNFKAPDKAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFINLLYPRYENIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDKWLKFVQENDMANN

SEQ ID NO: 57 - protein, 1225 aa, unidentified
MKEQLIGRYSLSKTLRFSLIPVGKTEETFHAHKLLEKDKKRAADYEKVKGYIDRFHKAYIESVLTQVQLADVPAYAALYRKSDKTDADLKQMEAYEEKMRKQIAKALTSGERYKRLFGKELITVDLPAFLTEEEEKEAVRPFESFTTYFVGFYDNRKNMYTAAPQPTAVAYRCIRENLPRFLDNVKSFAKIEKALPPETLRALDDDFLGLFGRNVRDIFCDGFFAFVLPQSGIDMYNGMIGGYTCSDGTKVQGVNEYVNLYNQSVAKNDKSLRLPLIKPLYKQILSDRETVSFIPEKFSSDDALLAAVKEYYTRNKAAFAALEGLFADLKEFRADGIYIRAGAAVTAVSNGVYGDWHALRAAWDAAYAAENPPKAKGDPEKYAEKREKLYKSIKSFSLAQLQALGVHADGDIAAWCTGTVAACAKTIGESYARCADLLNAPYAESHDKKLVQNSDATERIKNLLDAVKALELAVKPFLGTGKEEDKDDLFYGRFVTLYDAVSTVDKLYDKVRNYMTQKPYSQEKIKLNFDNPQLLGGWDKSKERDYRTVLLRKDGLYYLAVIDREHSSMFADAPAGNGEDCYEKMEYKLLPGPNKMLPKVVFAASNADLFKPTERILDIRRRESFKKGDAFNLDDCHEFIDFFKQSISKYDSWAGFGFTFTPTAEYKDISGFYREVADQGYTLRFQPVPAAYIDDLVENGCLYLFKIYSKDFSPFSHGTPNLHTLYFRMLFDERNLKDVVYKLNGEAEMFYREASINDKERIVHPANLSLKNKNPDNQKVESVFAYDLVKDKRYTKRQFSLHVPITINFKADGQEFLNYDVRRLVKNNPHPFVIGVDRGERNLIYISVIDGDGKIVEQTSLNEIIGDTGHRVDYQKLLDKKEKDRDSARKNWTTVESIKELKEGYLSQVVHKIGELVLKYDAVIALEDLNFGFKRSRFGVEKQVYQKFENMLVSKLNLLIDKNAAPDADGGLLRAYQLTNKFDGVNKSKQNGILFYVPAWDTSKIDPATGFVDLLKPRYTDVAASQRLFAALDGMRYNTATDMFEWDIDYGKFPKCCAAFRKKWTICTYKDRIETFRNKEKNNAWDHRRIMLTEAFKETFAAFGVDYTGDLQRTVVSNKSADFHKRLTRLFALTLQMRNSVTGSTLPEDDYLISPVADKNGDFYDSRRFSGKNAAMPCDADANGAYNIARKALWAIGVLKNTDDDRLDKADLTIRNADWLAYVQK

SEQ ID NO: 58 - protein, 1283 aa, unidentified
MKNLSEFTNLYSLQKTLRFELIPVGKTQKHIEYNGIIDCDTKRAESYKKMKKTIDKYHKDFIESSLRKASLSGLDEFYVLYTSNTEEKKTDAYKKRFSAAKQSLRKEIVKRFKDGPKKDIFKNLDKKKLIQDELEKWLQEKDNELYFNSDFKSFTTYFTGYNTNRMNMYSDEEKSTAIAYRLINENLPKFIDNMLIFEEIKNTTIYNKFPQIYEEIKEYLYVTRIEEIFELEYFNNTLTQTMIENYNAILGGVKIGNRKIKGLNEYINEYNQKSKDKRIPNLKMLYKQILSERETFSYLPEEFESTQEMLDAIAKFYENQLCSYSDEYSGEEINIVDSLKSIVSSLREHKLNKVYIRNDSSVDTISNRLFGDFSVIKASLEYYYENVVAPGFQESYKKASDKKRKQLEKQKKDYISGPAYFPIGLIQDALGCYVEQLDKNEYANIHAKYSDSCVADYFSAFEAKDGVNLINELNQKYKKAQDLFNISFPDGYNLLDYEKGILKAFLDSILSLLHFVKPLYLTPDSELSKDELFYSAFSPLFEQLQKITEIYDKTRNYLTKKPYSTEKVKLNFSNPTLLEGWDVNKEPDYGAVLFERDGLYYLGILNDRNLFKNIESRFDLHSSEKGSYRKIVYKQIPDAAKYISSKQILPQNPPQKIINILEKKKTNAQSLKREEIHSFIDYCKNDFLKNYSCLKDANGKDYFDFNLKPADEYETLKHFFDDVKKQAYSISFLGITEKFINEAVEEGKLYLFKIWNKDFSSFSKGKPNLHTMYWRALFADENLKNVSYKLNGNAELFHRKASISKDNMVIHKANQPIACKNPNLKQKTSVFEYDIIKDRRYTCDKYQFHVPITLNFKANGQTNINERVLKYLKNNQDINVIGIDRGERHLLYISLLNREGNVIMDEDGNPLQYSLNDIVGVYRDNSGALVSIKTPYRELLDKREIKRKDARKNWETIERIKDLKEGYMSQVIHHIAKLMVKYNAIIVMEDLNSGFKNSRVKIEKQVYQKFEKLLINKLNYMIFKDLPEKEPGGLYKAFQMTNKFESFKRMTRQNGFVFYVPPWNTSRIDPVTGFVDLLKPKYTNIPDARSFFSKFDSISFNSQSDYFEFEFDYSQFTEKANGTRTRWTVCTYGNERYTYNRSLNGGLGGYEKWNVTEKLKSLFDNVSIYYNSEENLIPQIISQENSAFFLELIKNLKITLALRYSDGNDRDFILSPVSNEGRFFYSEECEKTLPQDGDANGAFHIARKGLCLLKKIDLMEDLKKPDLKISNKEWLSFVQTRLV

SEQ ID NO: 59 - protein, 1319 aa, unidentified
MSEQFCGQGNGYSISKTLRFELKPQGATLENIKKLKLIESDLQKSQDYKDVKIIIDNYHKYFIDEVLQNVNLDWTKLADALIEYSKTKEDDSNVIKEQDALRKEIVKLISKDERFKPLTAPTPKDLFNSLLPEWFEKNASSALNEKAVETFKKFCAYFKGFQENRKNMYKEEAIPTAVPYRIVHDNFPKFLQNVASFAEIQKKCPEIIEQTETELSSYLGNEKLSDIFNVKNYNKYLCQTGAEKQRGIDFYNQVIGGIVQNENDKKLRGLNEFLNLYWQKHADFAKTNRKVKFIPLYKQILSDRTSLSFKIQTIGSDQELKEAILSFVEKMNSKNNDGKTVFDVATELCETITQFDLSQIYINQKDINNVSRILTGDWAYLQKRMNIFAEETLNKKEQKRWKKELDDDTSKTKGIFSFEELNAVLEYSSENCSPTTIRIQDYFGTTSRWYFDKQTEIFTKSGEIIEPSIKDLCAEIENNFIAINTLFETVPSEKTMREKPADVEKIKNYLDSVQNLLHRIKPLKVNGLGDANFYTAYDEVYSALGEVLSLYNKTRNYIAKKVGAPEKFKLNFDNPTLADGWDQNKESSNTSIILIKDDKYFLGIMNAHDKPQFQEKYESSGEKCYQKMIYKLLPGPNKMLPKVFFSKKGIANFNPPKNIIAGYDEKKHIKGDKFDIAFCHQLIDWFKDAISRHDDWKKFGFSFSATDSYKDISDFYREVSEQGYKINFVDIPESTIDEMVASGKLYLFQIYNKDFAEGASGTLNMHTLYWKNLFSKENLQDTVLKLNGEAELFYREQGIKEPIVHKKGSKLVNKVTQDGFSIPTEIYTEIYKFENGKQDKLSDEARKYFDEHKVIVKTAGHDITKDRRFTEPKFLFHVPITINFKAQGNTFAMNERVRKFLKNNPDVNIIGLDRGERHLIYLSLVNQNGEILKQFSFNEIGRNKNGQLVKVNYHEKLDNREKERDAARKNWNSIGKIAELKEGYLSAVIHELAKLMIQYNAVIVMEDLNFGFKHGRFHVEKQVYQKFEHMLIDKLNYLVFKDKGFSEAGGVLNGYQLAGQFESFQKLGKQSGFLFYVPAAYTSKIDPKTGFADLLNLRDLTNVHKKRDFFSKFDEVRYDAETESFAFTFDYKNFDGKGKSEMSATKWTVYSREKRIVYSPKSKSYSDVYPTDELKKIFEQCSIDFESGNNLIDSIMEIGADLKQNEKPTSDVANFWDALLRNFKLILQMRNSNATSGEDYIISPVKNADGTFFDSRKEKELGDKAKLPTDADANGAYHIALKGLLLLKRFAKTEESNLKKTDMKISNAEWFEFAQNRKV

SEQ ID NO: 60 - protein, 1300 aa, unidentified
MVTGTFESFIGLYPVSKTLRFELIPQGVTAEKIREKGVLESDKKRAEAYKRAKTIIDEYHKDFIERALQNVYIDWADLAAAIDEYRKNKDDKSRQQLRKVQETKRKEIVTFFKAQHDFNKMFSEKLFSELLPDYLQKKNEPDEDIKIINSFNRFTTYFVGFHENRKNIYSSDAISTSIAFRIVHDNFPKFYSNIASFKAIQLNTPEIIATATKELHELIGEKPLSEWFEIDGFNLVLNQTGIDLYNAILGGYTKDNTNTKIRGINEFTNLFAQKNPEKALPKSVTRMSALYKQILSDRESFSFMVDQYEDDADVFNALIHFSDKIKQAHLFDRLHELMSTVQSFDLNRIYIKEKEINSVSHQLFDDWSFLTRCLREWKTKTENIDLKKKKNIEYLEKWLKSEAFSIADLDQAVSYAEAQNNGQEAMQFPRIIDYLSMTNELISNFNTIENKVATLINKRNTITKLQEASEITALIKSYLDSILNIYHHIKPFKVGSDLELDMGFYDEFNILYDVISTIVPIYNKVRNYVTRKPYRDEKYRLHFEKPTLADGWDKNKEEDNNCILLFKDGLYYLAIMNAKNKPKLEDGITKNTNNCYKKMVYKFFKDVTTMIPKCTTQLKSVKKHFESNTSDYIIEEDTFSESFPVSKEIFDLNNVLYNGNKKIQDAYLKETGDTQGYKHALTQWIEFCLRFLKTYKSTKDYDFSGIRNAADYTRLSDFYKDVNQRLYRITFEYLSCEAVDNWVKEGKLFLFQIYNKDFAPGATGRPNLHTMYWEGLFDPKNLEDVVLKLDGQAELFYREASIFVPFRHKIGEKLVNKRTKDGRPIPDELYKEIFDYVNADCKPDLSEKAKALLPDVVIKNVSHEIIKDRRYTEDKFYFHVPITINFKADERRGGINNEVRAFLKNNSINVIGIDRGERNLLYATVIDPQGNILLQKSFNTIVNIDYATKLQHREKARDDARKNWNAIEGIKDLKEGYLSQVIHEISRMMIKYNAVIALEDLNSGFKRGRYKIERQVYQKFEKMLINKLNYLFFKDEDPLKPGGLFKGYQLTDKFTSFKELGKQCGFLFYVPAAYTSKIDPVTGFANVFDLRDLTNVQKKKEFFNQFDSIRYMPDMNLFCFSFDYKNFKVHQTCYKTKWTVFSNGKRIIWDPKLKTYKDIHPTEELSKLFDKYGISYQSGEELKNAIAEIDAVKANAPFFDALYSTFSRILQLRNTNSEEDYIISPVMSDSGIFFNSNEVEDGKLPVDADANGAYHIALKGLYLLRNIAAYADSSGQIKSNAIVIKNEDWFRFVQNQEYRK

SEQ ID NO: 61 - protein, 1250 aa, unidentified
MNNNMFKDFINKYSVPKTLKFELIPIGNTSENIKKYKIIETDRELEKGYEKVKLLIDEYHRSFISRVLNNIEFGESLLKYEEFYSHNTDLKREKFEIHKKEMRKKISKAFKDAGAAELFKNTLITKLLPGLYEGKDEVLNVLNLFKKFTTYFKNFHENRKNIYSSEEKSTAISYRIINENLPIFIHNIKTYERICSLIDFDTALEDSFLNQIKKELNCQFFSEFFNIHTFNRVLSQEGINSYNLLLGGKSEEDGTKIKGVNELLNLFCQETKEKLPKFKFLKKQILSDMDSKSFVLDAFNSDSDVLEAISSYHEYLMENIEGSEITLKEFIGQMKNENLDTIYIKDKQSLKSISQKVFGSWSTITEAIYSFEYDEKNGGKGSTNSVKYNEKKKNEFNKYYEQMAKSNTKLKKIYSLSYINKCIKYFGKSEDICDYFIGMGQYGVKEEVPGENLIEAITSNYSAIKFNFIDKILSENELLIEKVKRYLDSIKELQMFLKPLNKEGDKNPLFYGEFDRFYGALESVTPLYNMVRNYVTKKPYSKDKLKLNFSNAQLLNGWDKDKESDYLSLLFKKGSKYYLGVLNNKIPKVGKCFDCQFEVDSEDYYEKMEYKQLSNVVANIPRIAFSDSNKSLFSPSNEILKIQERGSYLKSSIDFDIKDLHQMIDFFKNGLKKKYSEYDFNFSNTSSYSNISDFYQEVIKATYKVKFRKVPSKFIDDLVDVGKLFLFQLHNKDYSIKSKGKKNLHTIYWESLFSEANLKNPVHKLNGEAEIFFRKSSIQRHITHPKGQLIESKREKGKFNKFSYDLIKDKRYTEDKFFLHVPITLNRSANDKGTNFNTEVCNVLSKFPEPHIIGVDRGERHLIYLSVIDSRGKIIHQESLNTITNSYIDGSGKEQVTEINYHSKLDKSEEERSQSRKNWKKIENIKELKQGYLSHVVHRITSLMFKYNGIVILEDLNFGFKRGRFHVEKQVYQKFEKALIDKLNLIVSKNVNENELGGIRKPYQLTSKFTSFKELGKQTGFLFYVNPNYTSKLDPTTGFSNQLLIKYESINKTKEFLEKFDEIKFNKEENYFEFHVDFSKFTQKKVGKTKWVICTKGDRISNFNRKQVYLTNELKELFNKYEIDYKNDIQEQFRQLELSKAFYESFLGYLRLTLQMRNNDPNKKDENGNEIDYIISPVKNDNNRFFDSRDVKNEHGLPVNGDANGAYNIALKGLMLLNEIKEATKEGRRPNLAIKNEDWFKFVQNKEYNG

SEQ ID NO: 62 - protein, 1362 aa, unidentified
MKHNFSNFTNQYSLSKTLRFELKPVGKTIEHIEAKGLISEDEKRAESYKKMKKTIDEYHKYFIELAMNSVKLTHLKEFQELFNTSAEQKKEESFKKELEKVQTSLRKEIVKGFSIGEAKEIFNKIDKKELITDLLEQWVKKQSDDFYFDENFKNFTTYFGGFHENRKNMYSDKAQSTAIAYRLIHENLPKFLENIKIFERIKAVPKVYEKCQTLYKEIEEYLNITQIDEAFELDYYNEVLTQTQIDVYNLIIGGRTAEEGKKKIQGLNEYINLYNQKQEKNKRLPKLKLLYKQILSDRISTSFMAESFSEDQEVIDAIEEYYKFHLLAFQAEDKDDTENILEKVKELLSNIKEYDLSKIYLRNDTKITAISQKIFGNYGVFNTALEYYYATAVKPDFQKEYEKANQKKRDTLDKAQTQFVKQPYVSIELLQTAIDAYIATIDKGEEIYKRYSPTCIADYFKNNFKAEKKEKNDKEYGFIDNIKAKYSCIQGILGTPYPKDKKLIQQKNDIPNIKAFLDSLMELLHFTQPLSIVDEREVTKILTSDRLKIDKEWAEEANKSFFEKDKKFYEQFDLYFKELQKLIPLYNKVRNYATKKPYSTEKFKLNFENKGQFLGGWVDSHTENSDNATQAGGYLFRKKNQIGEYDYFLGVSSDSKLFRSHLRNEIVDEDKSEFERLDYYQLKSASVYGNSYIGNQSYDKDKENLFDSIIEFANRNNPAAKEDFNKYISSQKGDNKPTPNGLLKILQEKHSKALEELMIDGDFIRINTIVTDNLKNTILSLNRIPKSQEYKNTIFTLFTEPIQVIEELSKEKSFSYFPVSAKELEDSLNRELKPLLLFKISNQDLSYADSFSQGKRKSRGRENMHTLYFRQLMSGSQNILDIGTGEVFFRKSSIENPTIHKANEAVTNKNPLAKKKDSAFEYDIIKDRRFTVDKFQFHLSIIMNYQKPQKASDFNFEVLEFLQNNPNVNIIGLDRGERHLIYLTLINQKGEILLQESLNNISSENYPITTPYHDLLATKEKERDEARKSWGTIENIKELKEGYISQVVHKIAKLMVEHNAIVVMEDLNFGFKRGRFKVEKQVYQKLEKMLIDKLNYLVFKDKDPNEIGGLYKALQLANKFESFQKMGKQSGFLFYVPAWNTSKIDPTTGFVNLFDTRYENLDKAKAFFSKFEDIRYNRTEKYFEFVVENYADFNAKAEGTKQDWTICSFGERIKNFRNPDALNQWDNKILNLTEEFKTLFTHNKIDITTELKEQIAQQNEAKFFKSLLELFKLTIQMRNSITNSEVDYLISPVKNKQGQFFDSRKADDTQPKDADANGAYNVAQKGLMWLEQINKFDGKDWKKLDLDKTNKGWLQFIQNKTQ

SEQ ID NO: 63 - protein, 1321 aa, unidentified
MKMSEQFCGQGNGYSISKTLRFELKPQGATLENIKKLKLIESDLQKSQDYKDVKIIIDNYHKYFIDEVLQNVNLDWTKLADALIEYSKTKEDDSNVIKEQDALRNEIVKLISKDERFKPLTAPTPKDLFNSLLPEWFEKNASSALNEKAVETFKKFCAYFKGFQENRKNMYKEEAIPTAVPYRIVHDNFPKFLQNVASFAEIQKKCPEIIEQTETELSAYLENEKLSDIFNVKNYNKYLCQTGAEKQRGIDFYNQVIGGIVQNENDKKLRGLNEFLNLYWQKHADFAKTNRKVKFIPLYKQILSDRTSLSFKIQTIGSDQELKEAILSFAEKMNSKNNDGKTVFDVATELCETITQFDLSQIYVNQKDINNVSRILTGDWAYLQKRMNIFAEETLNKKEQKRWKKELDDDTSKTKGIFSFEELNAVLEYSSENCSPTTIRMQDYFGTTSRWYFDKQTEIFTKSGEIIEPSIKDLCAEIENNFIAMDKIFETVPSEKTLREKPADVEKIKNYLDSVQNLLHRIKPLKVNGLGDANFYTAYDEVYSALGEVXSLYNKTRNYIAKKVGAPEKFKLNFDNPTLADGWDQNKESSNTSIILIKDDKYFLGIMNAHDKPQFQEKXESNGEKCYQKMIYKLLPGPXKMLPKVFXSKKGISNFNPPKNILAGYDEXKHIKGDKFDIXXCHQLIDWXKDAISRHDDWKKFGFSFXATDSYKDXSDFYREVSXQGYKINXVXIPESXIDEMVAXGKLYLFQIYNXDFAEGASGTLNMHTLYWKNLFSKENLQDTVLKLNGEAELXYREKGINDPIVHKKGSKLVNKVTQDXFSIXTEIYTEIYKFENGKQDKLSDEARKYFDEHKVIVKTAGXDITKDRRFTEPXFLFHVPITINFKAQGNTFAMNERVRKFLKNNPDVNIIGLDRGERHLIYLSLVNQNGEILKQFSFXEVGRXKNGQLVKVNYHEKLDNREKERDAARKNWNXIGKIAELKEGYLSAVIHELAKLMIQYNAVIVMEDLNFGFKRGRFHVEKQVYQKFEHMLIDXLNYLXFXDKGFSEAGGVLNGYQLAGQFESXQKLGKQSGFLFXVPAAXTSKIDPKTGFADLLNLRDLTNVHKKRDFFSKFDXXRYXAETXSFAFTFDYKXFDGKGXSEMSATKWTVYSREKRIVYSPKSKSHSDVYPTXELKKIFXXXSIDFESGNNXIDSIMEXGAXLKQNEKPTSDVANFWDAMLRNFKLILQMRNSXAASGEDYXISPVKNADGXFFDSRKEKXLGDKAKLPXDADANGAYHIALKGLLLLKRFXKTEESNXXKAXXXISXAXWFEFAQNRNN

SEQ ID NO: 64 - protein, 1236 aa, unidentified
MKKISNMIEIFKVQKTLRFGAKPEGKTGEYIIQNGILERDRKRSKDYKVLKFYLDECHRDFIDKALNNIELEELREYAELFFQSPKDNKNKMKQLEDKMRKQICEHFKESGKKKLLSKSVLTEVLPEYFAEKGVEIPDEVNNFKGFFTSRRGFCLNRENMYASEPKHTAVAYRCINENLPKFLRNIECFDKIKKVIAKEELDEISNKINFEPYRIEDCFSVDFYNLCLSQKGIDMYNTFMGGYSKEDGTKIQGLNEIVNLYNQKIKNNREKHKLPQITPLYKQILSDSVSKSFSLDKYDCAADVIKAVRESYMGDTLERIGKIFNELDEYDTSGIYIKNGTAITTISNAISDNWMLFRDNWNSEYDSKKKRSKIKDIEKYEENRNKTYKKIDSFSIDEIAGLLNKNVEDLIKYYQCNINELFKSITESYTIFKSVFDSKEVDEDDYEFSEKEIEEIKTYLDGVKKLESLLKQFMLNGKENNIDYVFYGDFIPAFDRICEIDSIYNKVRNYITSTRKPYKSDKYRLYFDNPQMLEGWDINKENARKTSMLLKDGQYYFAIINDKKSPFDNIPDEYVEDRDYYKKMIYKQIPNAAKYISGKNIKNPPLEILEILKKRKKDSKSLTEDEKNRFIDYVKTDFLVNYEPIIDKNGNRYFDFKFKNAEEYPTLEDFFEDVNRQAYSIRFEKISTRYINELVENGQIYLFRIYSKDFSEYSKGNKNLHTMYFEALFDEDNLENQIMKLNGGAEFFIRQASISKDKLIVHNKGQKLDNKNPLNSKKQSVFNYDLIKDKRFTEDQYMLHVSIDINKNAMKAENVQTINERVRKELKECDDNYIIGIDRGERNLIYICVINGNGEIVEQMSLNNIINEYNSVQHTTDYHKLLSKCEAERDKQRKSWKSIENIKELKDGYLSQVVHKICQLVEKYDAIIAMEDLNRGFVRNRLKFEKQVYQKFEKKLIDKLNYMVDKNKQEMENGGILKGYQLTNSFNKDSSFQNGFVFYVPAWLTSKIDPTTGFVDFLKPKYVSVNESCEWISRFDSIKYDKSIDMFGFDIDYSNFTRADIDYRKKWTFYSNGDRIEEFRNSNTNNKNDYKVIKLSEEIKKLLESYNISYIGGDDIIPAIKCISDKGFWVNFIRYIKLTLQMRNNITGKTDVDYIISPVMNNMGNFYDSRQYDNEDSSLLPQNADANGAYNIARKALWAIDRIKEAEDDELKNVKIAISNKEWIEYAQTHFIKKEC

SEQ ID NO: 65 - protein, 1335 aa, unidentified
MKMSEQFCGQGNGYSRSITVRNRLIPVGKTEENLKNANLLNSDFERAQAYTEVKNLIDEFHRAFIEDVLSKTKLDWDALYNQFDLFQAEKDNSKKAKQKKELEVLQGKMRNEIVEKFKGDERYDKLFKKELLTDLLPAIIKDDDSGTITDKKTALDTFKGFATYFTGFHQNRENLYSGEAKATAISNRIVNENFPKFYANVNVFEYMQKNFPNIVSDTENSLKDFLKGKKLSEVFSKDNFNAVLSQHGIDFYNTIIGGISGEAGKEKIQGLNEKINLARQQLPAEEKSKLRKKMTMLYKQILSDKKTASFIPVGFEKSEEVYNAVRQYKEHNFDKARHTIDELVSNPDYDLNQIFVPAKELSAFSLSVFGSWSIAGSGLFLLEKDKAKKELSEKQIKNIKKQIDKNDYSLIELQTAYNRWAKENGEQIDKTITISVYAYRTDENTKEKNSVNILEKVSEAYAKIDFERQENLQAEKEAATPIKDFLDEVQNLYHYFKLFDYRGEEEKDSNFYYKLDEILSDLAEIIPLYNKVRNFVTKKPGEVKKVKLNFDNVSLAKGWDVNKESDYTCIILRKSGKYFLGIFNPQDKPNFNEENNANDFNKKNDCYEKLVYKFFKDVTTMIPKCTTQLKDVKKHFESFSEDFILENDSFLKPLTISKTVFDLNNTLYDGKKKFQIDYLRNTNDVDGYNSAVKEWIAFCMNFMKSYKSTSVYDYSVLKDCSQFKQVDQFYNEINLLLYKIWFVNVEEAKIRNLVDSGKLYLFQIYNKDFAEKSSGKKNLHTLYWENLFSEENLRDVCLKLNGEAELFFRPKNENVKEIRHEKGSVLVNRTTADGKSIPEEIYQEIYQFKNKKRASVSDEAQKWLDGGTVVCKEATHTLTKNRHFTQNTYLFHCPITMNFKAPEITGKKFNQKVLKYLHKNPDVKIIGLDRGERHLIYLSLINQNGEIELQKTLNLVEQVRNDKTVSVNYQEKLVQKEGDRDKARKNWQTIGNIKELKEGYLSNVVHEIAKLMVEHNAIIVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTDELKKIFEQCSIDFESGNNLIDSIMEIGAELKQNEKPTSDVANFWDAMLRNFKLILQMRNSNAASGEDYIISPVKNADGIFFDSRKEKELGDKAKLPIDADANGAYHIALKGLLLLKRFDKTEESNLKKADMKISNADWFEFAQNRNN

SEQ ID NO: 66 - protein, 1308 aa, unidentified
MKMSEQFCGQGNGYSRSITVRNKLIPVGKTEENLKSANLLNSDFERAQAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHQNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLNVWGRDFGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKADLKISNADWFEFAQNRKV

SEQ ID NO: 67 - protein, 1306 aa, unidentified
MSEQFCGQGNGYSRSITVRNKLIPVGKTEENLKSANLLNSDFERAQAYTEVKNLIDEFHRAFIEDILSKTKLDWETLYDQFDLFQAENDSSKKAKQKKELEVLQGKMRNKIAEKFKGDERFEKLFKKELLSDLLPSIIRDDDSGTITDKQTALNTFKGFATYFTGFHQNRKNLYSDEAKATAISNRIVNENFPKFYANVNVFEYVQKNFPNIVTDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTDENTKEKKSVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLNVWGRDFGAKDAHIFIYGEKYYLGIINEKLNNEDIERLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEVRYDTETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPVKNADGTFFDSRKEKELGNKAKLPTDADANGAYHIALKGLLLLKRFDKTEESNLKKADLKISNADWFEFAQNRKV

SEQ ID NO: 68 - protein, 1280 aa, unidentified
MEGKRSFEKNNQNMYNRYRELIGLSSSSKTLRNSLIPVGSTLKYIQKHGILEKDTLRAEKREELKAIMDDYYRNYIDVHLRDVHNINWCELFDALEKVKKKQTDVTKKQLEKIQEKKRKEIYQYLSDDAVFSEMFKEKMISGILPDFIQTNGEYSEEEKKKNLETVALFHRFTSSFNDFFSNRKNVFAKEAMVTAIGYRVVHENAEIFLENIVAFQNIQRDAESQISIIERKNEDCFIEWKLSHIFIVDYYMMLMTQKEIEHYNDICGVVNQYMKEYCQKEKKNWNLYRMKRLHKQILSKTSTSFEIPGKYDNDAEVYEAVNRFLQNVIDKKVMERIAVLKNSTDSFDLNKIYITAPYYEKISNHLCGSWNTLTDSLTHYYEQQIAGKGERKAQKVKAAVKADKWKSLSEIKRLLEEYASTEEIKRKPEEYIAEIENIVLLKEVHPLEYHPEVNLIENEKYATEIKDVLDNYMNLFHWIKRFYIEETVEKEVDFYGELDDLYEEIKDIVPLYNKVRNYVTQKPYSDTKIKLNFGTPTLANGWSKSKEYDYNAILLQKAGKYYLGIFNPAQKPEKEIIEGHSQPLGGKEYKKMVYYYLPSANKMLPKVLLSKKGMETYLPSEYIINGYKERRHIKSEEKFDLQFCHDLIDYFKSGIERNPDWKIFGFDFSDTDTYQDISGFYREVEEQGYKIDWTYIKEADIDRLNEEGKLYLFQIYNKDFSEKSTGRENLHTMYLKNLFSEENAREQVLKLNGEAEIFFRKSSVKKPIIHKKGTILVNRTYMEEMHGETVKANIPEKAYQEIYNYMNHRLKGELSAEAKEYLKKAVYHETKKDIVKDYRYSVDKFFIHLPITINYRASGKEALNSVAQRYIAHQNDMHVIGIDRGERNLIYVSVINMKGEIIEQKSFNVVNKYNYKEKLKEREQNRDEARKNWKEIGQIKDLKEGYLSGVIHEIAKMMIEFHAIIAIEDLNYGFKLGRFKVERQIYQKFENMLIQKLNYLVFKDRPADEDGGVLRGYQLAYIPDSVKKMGRQCGMIFYVPAAFTSKIDPTTGFVDIFNHKAYPTDQAKREFILSFDEICYDVEKQLFRFSFDYANFATHNVTLARNNWTIYTNGTRTQKEFVNERVRDTGKELDLTKEMSNILEAEGIEFRSGQNLLPELEKVSNTKLFCELQRIVRFTVQLRNSKSEAVDDEYDRLLSPVLNEEGKFFDSFKYRDKDDEEEKILPVDADANGAYCIALKGLYIMQAIQKNWSEEEVLSPDVLRLNNTDWFDYIQNKRYR

SEQ ID NO: 69 - protein, 1301 aa, unidentified
MWTGEWVFSFYYGAEQIDSRGKNRRKFEKRKSVEQRFRACAAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHQNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLNVWGRDFGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKAEMKISNAEWFEFAQNRKV

SEQ ID NO: 70 - protein, 1315 aa, unidentified
MNVTLFFYKYHKQRIHNFIKMKGAKMGYENFINKNSCVKTLVNELRPTEWTRKHIEEDGILSADELRAEESDKLKSIMDDYYRRYIYTKLSGVNSLYWSEFFSIIEMAYKEGKKDKNCKAQLEKAQEEMRGKFYNVLSDDDIFKMMFSGKFVTKVLPEFVLNNKEYSDEEKQQKLDTLKLFKGFTTSLVPFFNNRENIFSKKPIHSSICHRTVDENTAIFYQNIISYKNIEDNAPQEIEKIEHHGRQQLDEWKLPDIYSYSFYNNVLTQQGIEFYNDICGIVNSHMNLYCQQTKEKSGQYRMRKLYKQILSISSTSYEVPYKYEDDAQVYSSINEFVDRIFNSNFSAKVEKMLGKAEEYDFDKIYIASKNYSSISNFISGKWNTLDDCIRRYYEDNTVGNGDKKEKKVEEKVKKDSFRSLDSIDKVVEMYGKGGKSAKEYIYQIREIYSDNKLYKFGQDGSDSVKLIENDAKIEHIKCVLDMLLNTNRFLDTFTVEDGEAIDVGFYSEIDDLKEIIDGIDPLYNRVRNYVTRKPYNKNKIKLNFNSPTLAEGWSKSKEYEDNAIILRRDGKYYLGIFNVKNKPDKKIMEGYSGYVGDGYEKMVYSLLPGAGKMLPKVFLSKKGIGNYKPSSYIIDGYDNDRHIKSSKNFDINFCHDLIDYFKASISANPDWKVFDFKFSDTKSYEDISGFYSEVEKQGYKISWVNISKEDIDRLDETGQIYLFQIYNKDFSESSMGTPNLHTLYFKNLFSEENIRETVLKLSGKGELFFRKASIDKPSGHRKGSILVNKTYKTNIGNEEVRVPVPDKEYMEIYTYLNNGRTTKLSENAQSLLDNKLVEYFEAEKEIIKDRRYTVDKFFIHTSVVINYNAEGASDKQLNEQVLEYISKQDDMHIIGIDRGERNLVYVSVIDMKGRIVEQKSYNVVNSYSYQKKLVERERTRDEARKSWKEVGRIKDLKDGYLSLVVHEIADMVIKYNAIIAMEDLNYGFKRGRFKIERQVYQKFESMLISKLSYLVDKTKKADEPGGVLKGYQLAFVPKDVKKVGRQCGIIFYVPPAYTSKIDPATGFVDLFKFKSGEKEGTARADNDRKEFLSKFDDIRYVEKNDNREEMFAFTFDYDNFAMHNTVIAKKKWTAYTFGSRIQKVYENGRYTSNTREIELSDKMKRLLNENNIEYGDGHNLVDDIRTLDVDSSGAVINEIFKIFRLTVQLRNSKSEAENEKNGEYDRIISPIMNDAGEFFDSFKYKKMNEETEPGKHNATMPIDADANGAYCIAMKCLYEAKNIKSGWEKEGKKNNDLLCVTNADWFDFMQNKRYV

SEQ ID NO: 71 - protein, 1316 aa, unidentified
MNGTLFFYKYHKQRIHNFIKMKGAKMGYENFINKNSCVKTLVNELRPTEWTRKHIEEDAILSADELRAEESDKLKSIMDDYYRRYIYTKLSGVSSLDWDELFSIMEVAYKSGKKDKNCKAQLEKVQEEMRGKFYNVLSDDDIFKMMFSGKFVTKVLPEFVRNNKEYSAEEKQQKLDTLKLFKGFTTSLVPFFNNRENIFSKKPIHSSICHRTVDENTAIFYQNIISYKNIEDNAPQEIEKIEHQGRQQLDEWKLPDIYSYSFYNNVLTQQGIEFYNDICGIVNSHMNLYCQQTKEKSGQYRMRKLYKQILSISSTSYEVPYKYEDDAQVYSSINEFVDRIFNSNFSAKVEKMLGKAEEYDFDKIYISSKNYSSISNFISGKWNTLDDCIRRYYEDNTVGNGDKKEKKVEEKVKKDSFRSLDSIDKVVEMYEKRGKSAKEYIYQIREIYSDNKLYKFGQDGSDTVKLIENDAKIERIKCVLDMLLNTNRFLDTFAVGDGEAVDVGFYSEIDELKEIIDGIEPLYNRVRNYVTRKPYNKNKIKLNFNSPTLAEGWSKSKEYDDNAIILRRDGKYYLGIFNVKNKPDKKIMEGYSGDVGDGYEKMVYSLLSNIHSNFPRIFIKSDECEKKYKLSQYIIDGYDNDRHIKSSKNFDIKFCHDLIDYFKASINANPDWKVFDFKFSDTKSYEDISGFYSEVEKQGYKISWVNISKEDIDRLDETGQIYLFQIYNKDFSESSMGTPNLHTLYFKNLFSEENIRETVLKLSGKGELFFRKASIDKPSGHRKGSILVNKTYKTNIGNEEVRVPIPDKEYMEIYTYLNNGRTTKLSENAQSLLDNKLVEYFEAEKEIIKDRRYTVDKFFIHTSVVINYNAEGASAKQLNEQVLDYISKQDDMHIIGIDRGERNLVYVSVIDMKGRIVEQKSYNVVNSYSYQKKLVEREKARDEARKSWKEVGRIKDLKDGYLSLVVHEIADMVIKYNAIIAMEDLNYGFKRGRFKIERQVYQKFESMLISKLSYLVDKTKKVDEPGGVLKGYQLAFVPKEVKKVGRQCGIIFYVPPAYTSKIDPATGFVDMFKFKSGEKEGTARADNDRKEFLSKFDCIRYVEKNDNREEMFAFTFDYDNFAMHNTVIAKKKWTAYTFGSRIQKVYENGRYTSSTREIQLTDKMKRLLNENNIEYGDGHNLVDDIRTLDVDSSGAVINEIFKIFRLTVQLRNSKSEAENEKNGEYDRIISPIMNDAGEFFDSFKYKKMNEETEPGKHNATMPIDADANGAYCIAMKCLYEAKNIKSGWEKEGKKNNDLLCVTNADWFDFMQNKRYV

SEQ ID NO: 72 - protein, 1305 aa, unidentified
MSLYNLVHQYPISRTLRFELKPYNKKVSDNIKHYGIIEQDHKLAKNYQEAKVIIDDYHRDYIEERLAQLILTDEELALLEQFETLQNKKNRDEKEREKLITLQDTLRKKIASHLKDDERYSRIDKVGLIREDLPAWLAAQKESATSEEKKTLSEAEMVVKSFYSFSTYFQGFFENRRNVYTDKAHSTGIAYRIIHDNLPRFCENREAIRYIKTHHPTLFTIFEKTVETLYQEGIITINSIEELFSLGALPLSQTEIKAFNRALGGDLKQGKKIQGLNEKVNLYRQQVAREDRNQSRQIPYFTRLYRQILSDYDPLVFETIENDEELIAELNDSSLQLIDRIPTQLEGETISLTTALSSLKEALENADIDTLWLRNNRAITDLSHTLFKDFDLIHTALEHYYKETYEDYRKENPTQTMERQKEAWLKSPHFALGFLEKALLFYRQSLDDDDPLKDKITEHCLLNFFITGLKREHPLLTTLTEKREALKQLIARVTTKWATGELYNLRQSDKDIALIKEYLDAVMAIFHHLRPLMVETVDEAGISYERDSFYTFFDTIYHHLDKIIPLYNRVRNYVTKKPYSKEKFKLNFQNSQLASGWDANKEKDYTTILLRKTHYRVDQAGEALKDKPYYCYYLAIMHNETKAKRVFEEFPTPEAGEDHFEKMYYKLLPNPHMQMPRIFFSKKGRERFQPSAEIDRIYKEKTFQLGKNFNQDDLHKLIDFYKIKLNDHPDWNEFNHTFSATKTFNNIGEFFTEVGNQGYLVRFDPIPTEYIEALIEKGEIHLFQLHNKDFSPHSHGMPNMHTLYWNALFSEENLKNTLYKLDGGAELFYRPASIERKVTHAKGEELTPKTDTARHRARTLDFDLIKDRRFTEDKFQFHVPITLNYQANGSGYINDAVNHLIQEKGETFNIMGIDRGERNLLYLSIINPHGKIIHQQDLNVMNSINYQERLEEAEKERQHARQNWQSIEGIRNLKAGYLSFAVHEIARLLVKHNALLVMEDLNFGFKRGRMKFERQIYQNFEKAIIDKLNYLLFKDADEKNGLPGVRHALQLTNKFESFQRLGKQSGIIFYVPANYTSRIDPTTGFVDLFGQKLRYQSIAQAKQFLSLFKMICYNPNRDHFEFTFRYADFGGRGKELTKEWQLIGDNQERFVYNRLKEIGEKAHFHERNERHLVANELKNLFDEMEINYQQGNNLIDKILTIDHAPFFRQLLFNIRVLTALRYYDNQGNDYILSPITNHKGTHFDSRKEEKAINHPLPHDSDGNGAYHIAHKGKMLVDKIIAHNLEGSRPDLKISNFEWFTYMQEK

SEQ ID NO: 73 - protein, 1309 aa, unidentified
MDAKKSIWDEMTNKYSLSKTLRFELKKPIGKTQEFIEKNGLIEEDEQRNKDFLCGKELLEGYYSDLIERRLGKIEIDSNLLEEYFKKYKEFNKLKQKGKEVDAKELKNSKDSLKASQRKLREELHKSFFDNDALFKDEEPFKEKRDNEDVIIAAVKFHRKKLLEKRNEGGVDNNLEIEEDKINCLYRFVNDHCTTYFTKFFNNRKNVFSDKAISTSIFYRTIHENLHFFVKNIENFEKLSEIIDEKELLEIEKELQKELGMFNLKEVFNINYFNNCLNQKGIDKYNQIISGVKKKDIQKEGLNNLINKLSQKKDKDQEERKNIRKLRMIQLYKQILSEPESKSFKIESIENGKELEENIFSFYKSIALPSENQKESVLTLLEKLFDSDELDFDGIYVKQKSINKISNKIHSDWYLIESALKERYKSKIKSTGKKDKTDLQKEKETKKWFKETKHFSINEINSAIEFTKNDLITKENKDIWKYFKGVKTKEKNLFNEIQTSFGDLKKVKFGKERELLYDDNEENVVKIKKALDYVQELFWLISPLMYEKPKEGVFDLDLNPDFYEKFVQIYEELQQITPLYNKTRNFISQKPHCESKFKLNFGDGYLLNGWAEKDGRCGYRAVIFRQGNKYYLGIIAKGKKNTKMFDKIPNYKSGDYYEKMKYNQLQKPDQNLPRIFFAPSNEKYYNPSEEIKSIKNKGSFRTNIEDCHKMIEFYKKSISKKSEWDIYKFKFKETNDYVSIDEFYKDFSNQAYKIEFQKISVDDIHELVDSGKLYLFTIYNKDFSEKKFKKDFSKRKPNLHTMYWKELFSDENLKNVVYQLNGGAEIFFRKKSPSNKKIIHIKNKAVPNEKPINGRKESTFEYDLIKDKRYFEDKYLFHCPITLNFKSEKNNVESFNNYINEFIVKNNDEINILGLDRGERNLLYYYLLNPNGEKIKSGSFNIFKDEFGREFDYHKMLSEREDERDKDQKEWKNIKNIKDLKEGYLSRIIHEISKIVIDNNAIVVLEDLNPDFKRNRFKFENQVYQKFEEKLIKKLNYLVFKNRKSTDSGGLFRAYQLTSKFVSFKNLREQKQSGILYYVNANYTSKIDPKTGFVNLLYPNYKNIEKSKLFFDKFDSIKYNKSENMFEFEFDYSNFTKNLKLKKNNWTVFTNGERIIQVKTKNNIYEPKKINLTNEMKNLFESEGISFNDGKNLKEEIINSNSKKLHTNLTNLLKYTLQLRNSNNKTGEDYILSCVKDDEKNFFNSNNAKDSEPENADANGAYHIGLKGIMLIKKMKKQSDKNQKIDLRISNEEYFNEMCSKEQSKKKES

SEQ ID NO: 74 - protein, 1294 aa, unidentified
MSSVFSDFTNQYQLTKTLRFELKPVGKTLEYIKENGLLSDDKLRAENYTKIKDIIDDFHKDFIDKSLKQADIRWDDLKNGIENYRKDNSKKNKDELEKLQKRYRNEIVECFKKDKEIFSYLFKKELITEILPEYIKNKETFEAERDILSSFSRFATYFTSFQETRKNIYSKNAISTAISYRLVHQNFPKFISNIEVFNKISEVCADIILDTERELAEILDGRRLRDVFSIEYYNNVLCQSGIDDFNRCIGGYSKDDGVKIRGLNEFVNLFNQKNNGLMLSKMTPLYKQILSDREKISFIPEKFDNDFQVKSAINEYCNGLLKEDIAALVDELVLNYAQGNSNNIYIVGKEFTNLSKMLTDSWSTINDSLYLFAVSLFGDNDKKSTKEKINRWIKSAEFSVKTMKDALLMNGIDVKIEKLFDTIKQKTDVIIKEYEAIKPYLCNDEKFLGNETGIERVKSLLDAIMELMHMLKVFNVSNELDRDMSFYSVYDTIYNNLTEVIQLYNKVRNYATQKPYSEDKYKLNFENKGNFLNGWVDSKTESNDNGTQYGGYLFRKRNLLNQYDYYLGVSSDVKLFRECKDSNVFCDYERLYYYQPKVSTIYGSAYKGEKTYAKDKSELITIIDDFVSCCDIDNDKLIAFKEKVELTPNGYINWLKKEYPSIFEKLICNQEFKNKNNEIIGNLKKALKDLIPKMPYVQQYIEKQYTIVNEIISDIEEISHNKILTYIKINRREMENALSRGTKRLYLFKITNKDLSFAESFEKGYRKEIKNKNLHTLYFEQLMSGGNSVFDLGTGSIFYRPASIESPFVHKKGEILIDRKDKNGNPIPMDIYDQLFNHFNYGSTLSEEAKKYKDIVVVKNAKHDIIKDKRFTQDKFLFHLSITINYKATGSGYINAKVLNAISNNPNVNIIGIDRGERNLLYVSLINQRGDIITQKSFNIAGGFDYAAKLTQYEKNRDIARKDWKQIGNIKELKEGYLSVVIHEIIQMMIKNNAIIVMEDLNFGFKRGRFKFERQVYQKFEKMLIDKLNYLADKKKNPADEGGILRGYQLTEAFTSFQKLGKQSGFIFYVPAGYTSKIDPTTGFVSLINLKWTSIENAQKIISAMDFIRYNSSEDYFEFGIDYDKLRTAQTDFRKKWTVCTFGDRYTHTQNKATSNHTTEKVNLTAKLKAVLDKYSIDYDKGEDIRDILCKSNSKELLETVLYVLKLAMQMRSTSPEDDVDMIISPVKNDDGKFFVSGNDEKLPIDADANGAFHIALKGLMYIKRIKNGKIECFDKGMATYEWLKFMQNREYKS

SEQ ID NO: 75 - protein, 1281 aa, unidentified
MNILKENYMKEIKELTGLYSLTKTIGVELKPVGKTQELIEAKKLIEQDDQRAEDYKIVKDIIDRYHKDFIDKCLNCVKIKKDDLEKYVSLAENSNRDAEDFDKIKTKMRNQITEAFRKNSLFTNLFKKNLIKEYLPAFVSEEEKSVVNKFSKFTTYFDAFNDNRKNLYSGDAKSGTIAYRLIHENLPMFLDNIASFNAISGIGVNEYFSSIETEFTDTLEGKRLTEFFQIDFFNNTLTQKKIGNYNYIVGAVNKAVNLYKQQHKTVRVPLLKPLYKMILSDRVTPSWLPERFESDEEMLTAIKAAYESLREVLVGDNDESLRNLLLNIEHYDLEHIYIANDSGLTSISQKIFGCYDTYTLAIKDQLQRDYPATKKQREAPDLYDERIDKLYKKVGSFSIAYLNRLVDAKGHFTINEYYKQLGAYCREEGKEKDDFFKRIDGAYCAISHLFFGEHGEIAQSDSDVELIQKLLEAYKGLQRFIKPLLGHGDEADKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAISYDDGMYERLDYYQLKSKTLLGNSYVGDYGLDSMNLLSAFKNAAVKFQFEKEVVPKDKENVPKYLKRLKLDYAGFYQILMNDDKVVDAYKIMKQHILATLTSSIRVPAAIELATQKELGIDELIDEIMNLPSKSFGYFPIVTAAIEEANKRENKPLFLFKMSNKDLSYAATASKGLRKGRGTENLHSMYLKALLGMTQSVFDIGSGMVFFRHQTKGLAETTARHKANEFVANKNKLNDKKKSIFGYEIVKNKRFTVDKYLFKLSMNLNYSQPNNNKIDVNSKVREIISNGGIKNIIGIDRGERNLLYLSLIDLKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKGANETGGLLHALQLTSEFKNFKKSEHQNGCLFYIPAWNTSKIDPATGFVNLFNTKYTNAVEAQEFFSKFDEIRYNEEKDWFEFEFDYDKFTQKAHGTRTKWTLCTYGMRLRSFKNSAKQYNWDSEVVALTEEFKRILGEAGIDIHENLKDAICNLEGKSQKYLEPLMQFMKLLLQLRNSKAGTDEDYILSPVADENGIFYDSRSCGDQLPENADANGAYNIARKGLMLIEQIKNAEDLNNVKFDISNKAWLNFAQQKPYKNG

SEQ ID NO: 76 - protein, 1261 aa, unidentified
MQITIFTNKNKRNKNNMENSNLFTNKYQVSKTLRFRLEPTGGTDDLLRQAQIIEGDERRNKEAITMKQILDNCHKQIIERVLSDFNFKEHSLEEFFKVYTRNDDDREKDIENLQSKMRKEIADAFTKQDVTKLFSSKFKDFVERGLIKYASNEKERNIVSRFKGFATYFTGFNTNRLNMYSEEAKSTAISFRLINQNLIKFIDNILVYKKVSQTLPSDMLSNIYIDFKAIINTSSLEEFFSINNYNNILTQKQIEIFNAVIGGKKDKDEKIITKGFNQYINEYNQTNKNIRLPKMMRLFNQILSDREGVSARPEPFNNANETISSVRDCFTNEISKQITILSETTSKIESFDIDRIYIKGGEDLRALSNSIYGYFNYIHDRIADKWKHNNPQGKKSPESYQKNLNAYLKGIKSVSLHSIANICGDNKVIEYFRNLGAENTVDFQRENVVSLIDNKYNCASNLLSDAQITDEELRTNSRSIKDLLDAVKSAQRFFRLLCGSGNEPDKDHSFYDEYTPAFEALENSINPLYNKVRSFVTKKDFSTDKFKLNFDSSSFLSGWATKSEYEKSSAFIFIRDNQYYLGINRCLSKEDIAYLEDSTSSSDAKRAVYLFQKVDAKNIPRIFIRSKGSNLAPAVNEFQLPIETILDIYDNKFFTTSYQKKDRTKWKESLTKLIDYYKLGFSQHKSYADFDLKWKASSEYNDINDFLADVQKSCYRIEFININWDKLIEFTEDGKFYLFRIANKDLSGNSTGLPNLHTIYWKMLFDESNLKDIVYKMSGNAEVFMRYNSLKNPIVHKAGVEIKNKCPFTEKKTSIFDYDIIKDRRYTKDQLELHVPILMNFKSPSAAKGNVFNKECLEYIKNNGIKHIIGIDRGERNLLYMVITDLDGNIVEQKSLNQIASNPKLPLFRQDYNKLLKTKADANAQARRDWETINTVKEIKFGFLSQIVHEIAMSIIKYDAIVVLENLNRGFMQKRGLENNVYQKFEQMLLDKLSYYVDKTKHPEEAGGALHAYQLSDTYANFNSLSKNAMVRQSGFVFYIPAWLTSKIDPVTGFASFLKFHRDDSMATIKSTISKFDCFKYDKECDMFHIRIDYNKFSTSCSGGQRKWDLFTFGDRILAERNTMQNSRYVYQTVNLTSEFKNLFATKDIDFSGNLKDSICKIEDVGFFRKLSQLLSLTLQLRNSNAETGEDFLISPVADKDGNFFDSRNCPDSLPKDADANGAYNIARKGLMLVEQLKRCKDVSKFKPAIKNEDWLDYVQR

SEQ ID NO: 77 - protein, 1353 aa, unidentified
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWDTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVNLQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNKPTLADGWSEGKIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMFFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 78 - protein, 1325 aa, unidentified
MLNKIIKEKIMSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWEARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQKLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLADGWSESKISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 79 - protein, 1325 aa, unidentified
MLNKIIKEKIMSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWEARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLADGWSESKISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 80 - protein, 1280 aa, unidentified
MTAKNTGIWDEFTNQYALSKTLRFELKPVGYTQNMLEEAKVFEKDETIQKKYEATKPYFDRLHREFVREALENEALSGLNEYLEIFKKWKADKKANEKELQTKEKELRKEVVEFFDAQAKIWAFEYSPLGIKKNSVGILFEEDIFKILKARYGNEKESIIIDESTEKLISVFDSWKGFTGYFGKFFKTRENFYKDDGTSTALATRIIDQNLKRFCDNILIFENVREKMDFSEVEANFGKPLSELFSIDFYNTCFLQDGIDFYNKILGGETKENGEKLKGLNEYINKYRQDHKGDKPLFFKTLDKQILSEKESFIVDEIIEETLLENLQNFYESAERKTKLLKELFKDFIQNQEKYDLSQIYLSKESLNTIAHKWTNETVIFEESLYEVLKKEKIVSTSAKKKEGGYSFPDFIALSVIQEALTKISAANFWKERYYELAGFPEMPHWEQFLEMFYFEFSSLFERKVTNTEKREGSKVGYDFFKKDFKNLLQNLTPDHLSSEDKAVIKNFADCVLTIYQMAKYFAVVKKRAWNMDYELGIFYTDPENGYLLFYENAYEEIVQSYNKLRNYLTRKPYSEEKWKLNFENPTLADGWDKNKESDNSAVILRKDGKYFLGLMSRGNNKIFDDRNKEKFSQNIQQGNYEKVVYKFFPDQAKMFPKVCFSAKGLEFFQPSEEIWNIYKNAEFKKGDTFSVQSMQKMIDFYKVCLNEYEGWKGYDFKHLKSTKDYKENIGEFFRDTAEDGYKITFQNISESYVDKKNENGELYLFQIKNKDWNEGSNGAKNLHTIYFESLFSVDNISQNFPIKLNGQAEIFYRPKTEKEKLGTKKDKSGKEVVNHKRYNENKIFFHVPLTLNRTKPDMSSKQFNAKVNNFLANNPDVNVIGVDRGEKHLAYYSVISQKSEILDSGTLNEINGVDYSQKLEEKAKNREQARKDWQTVEGIKDLKKGYISQVVRKLADLAIEHNAIIVFEDLNMRFKQIRGGIEKSVYQQLEKALIDKLSFLVKKGEKNPEEVGHLLSAYQLSAPFTTFKDMGKQTGIVFYTQAAYTSKIDPITGWRPHLYLKYKSSKKDGPLATKEDILNFSKIEFVNGRFEFNYDIKKFQPNNKEYSEKTVWTVCSSVERFRWNRHLNNQKGGYEHYQDLTDNFKALFEENEIDFESGDILGKIEVLEPKGNEKFFKNFIFFFNLICQIRNTNDQAKNLDQQDFILSPVQPFFDSRIPEKFGDNLPENGDDNGAYNIARKGIVILNKISNHSQTDPKFKKYPELFVSNIEWDNFIKTES

SEQ ID NO: 81 - protein, 1355 aa, unidentified
MKSKQSPPFHNFERLMPSQKTIRFRLIPVGKTKKYLKNRNIIESDRMRHEYYPLVKEMADRYYRQHTHDVLSDLCIDWTSLKEVIELKKSTNETNSDSDIDSRIASEQQKYRTILLDRLSRQIDSEGNAYPKEIASKNKSMYKKLFQAPFITKVLPQYLEELKSSANLEMTEVEYDLNKSALLQYARFTNRLINFWDARRNIFTDEDISTSLTHRIVNEIFPVFLNNRDLFYKNKPYFSDKLQTLEFELKKKGLIEETETLDHLFELSSFNRLLIQPGVDLYNAIVGGFFVEEKKKIQGFNELVNEKNNSLKNNNSDDPSMPLGKMTRFKKQILAISESTSFLFEQIEGDADLYYRLNEFHNLITKKDLDGLSVIDLHNQLMRSIKSVDLSTIWVDAKNLNKLSRLVSQSWNRLREGLHLMAEEESYKKDERFKSYVEKSIEDKDFSKLKKKIYFNLQELQNAIDHMEAIEENNDNPSSIISPFVTASEEMGPELQTLYDSIVRLQTEESKLQGNPDAIAIIKEYLDAIIAKYSKWNLLECDDTSLHDPLFYPEYQRLIDNLSHIIKLYNLARNYLSQKPDHKKKFKLNFMKPTLADGWSEGKVASNLSIILRKHGNYYLGILKDSRVFKVLESGRWGNDLDCNELPYERMVYYLMPDSFRMIPKCSTALNNVKKHFLEEKQTTDFTLLPETSSFLEPFTIPHNIFSLQTETTKNKKKYQKDYLKQTGDEVGYKSALVSWIDFCKDFLAKYQGTSMFDYSHLLDSDQYEDINQFYNDVDRASYLMSFEELPSSLIDELVEKGDLYLFQLYNKDFSPHSTGKPNLHTLYWRALFSDENLQSRTIKLNGKAELFYRPRQIEAPFTHEKGTILLNKFDRFGKAIPAEIYQEIHDYVNNKIDSQSLSQEAKAGLEEGRFDYREAPYDIVKNRRYAEDQLFFHVPIEFNWAEQGGVNIDNLTQEYVKTTSDIHVIGIDRGERHLLYYSVLNIKGDIVEQGSWNTLSQENISEQGVQKREIPYHGMLKQREDDRAVARQNWQSIDRIKNLKAGYLSHVIHELSKLIIKYRAIIVLENLNKGFKRGRFKVERQVYQKFEVALMNKLNLLSFKSIPPTELGGILRPWQLTRHLVKLDDAGRQNGVVFYVPASYTSVVDPVTGFVNLFHFNKIKVKDLRDFYECFSSLSFDSDKGHFVFSFNYKKLDKYCRVENCPAREWNVISGERSTFDKKHKKTIIIDTTEQLRKLFDDKAIAYRKVRNLLPEILDDSDLLRKMHSSFKLIVQMRYTVDDVDAIVSPALNDEGVNFDTRRQLEGGKLPTNADANGAYNIARKGLLIVNKIKRGEQSRFVTNKEWFKYIMNN

SEQ ID NO: 82 - protein, 1475 aa, unidentified
MIYNVKLKKLTNSSDVFSLFSRKYSLSKTLKFELKPTAETKQHLQDFIVSDTKRAKEYKELKKIIDEFHKDYIELTLSHKNILDKDKLTDFCKLWSDNNLLDEIKEKHNLKEKTKEEVIKKMEQQFRKDIVEQFKTLNPLLERFFKTADEEQLLGFLKKLDNKLWTKFKEKKEKALLDEYLQEPIKQKNIEKSILFSSELIKYLLPVWLKNSQLTDKEDKQKIIKNFGRFTTYLTGFNENRKNMYSVEEQGTAIAHRIINENLMKFLGNLQAYEKIKSSHPELQQSFKNMKSDFKEEFDYFSLENIEDLFKPEFFNSCLSQKEIDFYNTLLGGKTVEDGKKLQGINEYINLYRQKKKSEDIDIKIKYSNKNLPTMELLYKQILSDRESHSFILAEFENKKELLEALKSFWSVLFEEKTYQDYFHTKKKTSLWNNLHSLLTGRSYYDLEGAYFKSSELNKLSHNLFKDYRIITEALNENYDKIKVTLESYKKVLKKEDKKEFEKNIKSLKGFQTEWKKILSFEKNKEELKFSDEILASYFEFPIDKKTKKKNQKDFYSLQEIKDHIELYSKESDELKEDLDNLKKKLKDYKKDNIISSWFKYQFESKQNLDFFLQRNHEKENEDKREQNKNSLFSHIENHYQKIQNLSLDEKEFKKEEVEDIKFFLDLILHVLHLMKPFYLEGKASNLLDKGINNEIEVLYKKLKPIEKLYNQTRNYIAKKKSRYNKVKINFEDSTLLDGWDLNKEKDNLAVLLRKKDAVIGWKYYLGVMNKTTKDLFDYHIKLDDSEKVKQKKEELQDLILHRENDGNFYEKMNYKLLPDPSKMLPKVFFSKKNLDSFKPSEEIVRIRDNKTYAKNGGQDFSKADCHKFIDFYKESLKKHKEWNDFFKFNFSPTSQYNDISDFFQEVKNQGYNLQFDKIKSSYIEEKVKTGELFLFEIYSKDFSTKSKNRKNSKDNLHTIYFKGLFEKENLKDTVLKLNGKAEIFYRKATKKFNITHKKNTELENKNKNNPNKHSIFNYDLIKDKRFTEDKFFFHFPISLNFNSKGMKSYLFNQEVLKCLKGNKEVNIIGIDRGERHLAYYTIINQKREVLSQGSFNKMESSYKDNSGKEVKIEKDYHELLESKEKERDKSRKEWNKIENIKELKSGYLSYLVHKISKLMIEHKAIVIFEDLNLGFKRGRFKFEKQVYQKLEKALIDKLNYLVFKDKKSSELGGYLNAYQLTAPFESFQRMGKQTGYLFYVPAYYTSKVCPLTGFINLIYPKYKNVKESQQFFEKFDRIYFDKNKNYFVFEYQDKKVNPSKKTESIETLWKVCTHGEERYKWDVKDRKMIEVNVTENLKKLFEEHKIEYRQIADLKSTITKQEKKDFFSKLIDGLKITLQLRHINPDSKDEKEKDFILSPVADESGRFFDSRKAKEGEPKNADANGAYHIALKGLRTLENITSDKKDKLKLQAITNKDWFSFLKENSNKKIPKVG

SEQ ID NO: 83 - protein, 1324 aa, unidentified
MNVKKSPTTFAEFTNQYSLSKTLRFELKPVGNTQKMLEDFGIIEKDEIIAQKYKITKKYFDKLHRTFVEEALFGKKIEGLDNYFELYRNWKKDKKANQKDLQNKETELRKNIVTLFNKMAKTWSQKETFKGLKNNNIEILFEEAVFKSVLKVLYGDEDESFLRDKVSGEFLLDKDGNKISVFDSWKGFTGYFTKFNETRKNFYKDDGTATAHATRIIDQNLKRFCENIIIFESIKDKLDLSEVENVFDISLVDIFSVTNYGDCFLQAGIDSYNTVLGGETLPNGEKKKGLNELINLYKQQTREKLPFFKSLDKQILSEKDKFTDEIEDAGALKEVLTVFLKNVDVKIQKFSLLITDVLNNPDAYDLSQIYLAKEALNTISRRWLVSFSTFEDALYTVLKNAKIISSSAKKTEGGYSFPEFIPLSYLKEALEKMVEDKIWKEQFYVTVEGLKNNGVIIGNKPVWQQFWEIYRFEFEQLKSRIEIDSQIGTTHPAGYSVSKTALETILKDFKEDDVAPKLAIKNLADDVLHIYQLAKYFAIEKKIEKKRRWEGDNFELDVFYTNPDFGYFETFYKNAYEDIVQVYNKLRNYLTKKPYSQEKWKLNFDNPTLAAGWDKNKEADNSAVLLKKDGKYYLGLMEKSHNRIFDKKHEALFLDNNQSENYEKVVYKFFPDQAKMFPKVCFSVKGLDFFKPSEEIYKIYKNAEFKKGDTFSIKSMQSLIKFYIDCLQKYDGWKGYNFKHIKSSNQYTNNIGDFFRDVAEDGYKITYQDVSDSYIKEKNNNGELYLFQIKNQDWNLDKAINGIKKTTTKNLHTLYFEALFSKENAEQNFPIKLNGQAEIFYRPKTSQGKLGTKLVNNKEVVNHKRYSEDKIFFHVPLTLNRTKNRTKNEAQKFNSKVNEFLVNNPNINIIGIDRGEKHLAYYSVINQQGEILSDAKGIPAIGSLNFVGQGADGKEIDYAEKLAIRASERESSRRDWLDIEKIKDLKKGYISQVVRKLADLAIEHNAIIVLEDLNMRFKQIRGGIEKSIYQQLEKALIEKLSFLVDKGETDPEKAGHLFRAYQLTAPFESFQNIGKQTGIIFYTQANYTSKTCPECGFRPNVRFDESIDWNLINIKYYDNDFTISYSLKTFTKAKETSKRSNQLFTGINKKDSFILSTKNAIRYKWFRRNISAVELSAGESKLINETGSGVTIQYQLTDCMKGLFEGNGIDIKGNINSQLRTGGHLMKFYKQLANYLYLLSNTRSSVSGTDIDIINCPCCGFDSTQGFKGVAYNGDANGAYNIGRKGLIVLDKIKNYQKNNGPLEKMNWGDIFIDIDEWDKFTQK

SEQ ID NO: 84 - protein, 1235 aa, unidentified
MKSDFFAPFTNLYPIQKTLRRELKPLNENFQHDPALTALRNSEIPQRDQQREKDYQAIKPLLDELHNQFITESLQSLETQDRSDFVLFYQTYQKKKKNKADFSEKELKSLDEEFESRTKSLRTAIGNSYAKLAELRKSNPDYVNEKGKPFLDQKSYKILTEAGVLGLLEKKYASDLEKLALIRRFGNFFTYFTGFNQNRENYYTTDEKATAVAYRAINENLLTFANNCELFEKLAVLGLSELEKKIFNPDSYSEYLTQSGIDFYNEMLANIRSKANLYTQEHKTKLPQPKLLYKQIGSPRGNTIPFDLINNDEEFKKMLHTMIAETDQRIPEFNKLLESIFEENADLSQIFLSKTSLNIISNRYFSSWNTLLEKGVELKLFKFKKNDEESFKLPTYLSLAELKELLEAVPFQTAEKSDTAEGTHHQVSLLKLQRENLHLESSHSNWELLLKSMKSDFESFWTGEGEFGSYTSAKKALQSLSSLQSTNQEHKNLIKMLLDNTLYAYRMLKWFKVDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPGANKMLPKCLMPGSDKKKYGASDQVLELYAKGSFKKSEKSFNLADLHTLIDFYKSALPKYEDWKVFNFQFQATENYQDISQFYREVEQQGYLLNRRKVNEELIKQGIKDGSLFLFQISSKDFEGKSKTPDLQTLYWCQLFESPTNVKLNGEAEIFFRLGSMKKEKKTLKVDNYDVFKHKRYTEDKILFHVPITLGFGNNEVSASAPSKFNQKLNQELIIPHFDDLHVIGVDRGEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVVEPGSVTSAYQLAPQINTFGDIKGKQRGIMLYTRANYTSVTDPLTGRRKQYYFKKGSSEEMKAQFFKSFKNLTRDAGQKAYIFDDGTWQLYSNVERRRGKRGDHRERTQIKYDPSLELDTLFSKYQIEKSDSLLDQLKNRDLPQTFWTSFFRILDLIMQIRNTDDEGRDIILSPIGNAQERFDSRKRYDQLPRDEKGVVIEESAFEYPTSGDANGAYNIARKGVMMLERIKENTEKPDLLIRDAEWDKKITN

SEQ ID NO: 85 - protein, 1234 aa, unidentified
MKSDLFSPFTNLYPIQKTLRRELKPLNENFEHDLSLSALRNSEIPQRDEQREKDYQAIKPLLDELHNQFITESLQSLEPQDRSDFVLFYQTYQKKKKNKAELSEKELKSLDEEFESRTKALRTAIGMSFSNTADLRKSNSEYVNEKGKPFLTQKSYKILTEAGVLGLLEKKYTSDPENLALIRRFGNFFTYFTGFNQNRENYYSTEEKSTAVAYRAINENLLTFANNCEVFEKLAVLSLSELEKKVFNPDSYSEYLTQSGIDFYNEMLANIRLKANLYPQEHKAKLPQPKLLYKQIGSPRGNTIPFDLITSEAGFQKMLHTMIAETDQRIPEFKKLLAQIFEEKADLSQIFLSKTALNIISNRYFSSWHTLLEKGVELELFKFKKNDEESFKLPAYLSLAELKELLEAVPFQTAEKSDTAEEKHHQDSLLKLQRENLHGENSHSNWELLLKSMKSDFESFWTGEGEFGSYTSAKKALQSILSLESTNQEHKNLIKMLLDNALYVYRMLKWFKVDTSKLGFVPEGEFYPSLDQLLQDYSLPKWYDMIRNYLTRKPYSESKLKLNFDCSTLLNGRDKNKETQNLSVILRKDGKFYLAIMKKDQNKFFEKSVLYEGHLGTMEKMDYKLLPGANKMLPKCLMPGSDKKKYGASDRVLELYTKGSFKKSEKSFNLPDLHTLIDFYKSALPKYEDWKVFNFQFQATENYQDISQFYREVEQQGYLLNRRKVNEELIKRGIKDGSLFLFQISSKDFEGKSKTPDLQTLYWCQLFESQTNVKLNGEAEIFFRPGSMEKEKKTLKVDNYDVFKHKRYTEDKILFHVPITLGFGNNEVSPSAPSKFNQKLNQGLIIPHFDDLHVIGVDRGEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGEPGSVTSAYQLAPQINTFGDIKGKQRGIMLYTRANYTSVTDPLTGWRKQHYFKKGSSEEMKAQFFKSFKNLTRDAGQEAYIFDDGTWQLYSNVERRRGKRGDHRERTQIKYDPSLELDTLFSKYQIEKSDSPFDQLKNCEFPQTFWTSFFRILDLIMQIRNTDDEGRDIILSPIGNAQERFDSRKRYDQLPRDENGLVIEESTFEYPTSGDANGAYNIARKGVMMLERIKKNPEKPDLLIRDVEWDSWII

SEQ ID NO: 86 - protein, 1363 aa, unidentified
MKNFENFTNLYEIQKTLRFELIPSGAKIENDEIVGEEFFKGKTWTEYFLAKNEIFGKDKIVYESYKKIKPFLDKLHTIFINESLKDLKLDFGNTETKFLEWQKENDKTKKDKLKEEIFGKNGKGGIFGKLRNDINKKFEKNGKNWKDLYEKKLTVTDEKGKEKKIKIKGEGYKILLSDTNLDILSDIFSEEKEGENVLIENIKGEKVNLFKSFKGFTTYFSNFNNSRENFYKDDGKAGRIATRIIDENLIFFLKNKKNFDEKFKNENYFSIEMNKVLENFGENLNDFFSLEFYNKCFTGTQIEYYNQIIGELNSVINSKKQADYSKHIQDKKEKKDTEFKKQNYPLFRELYKQILSEEKEEQKFIEIENFSDIKKYLQELEIKNTEKNNFVKEFINDFVENFEEDYDLQKIYISKISLNTISAKFFGSQKWFLIQEDLLERIGKKNKNDKKDLPDFLSLFEIKNSLIKIQKEHEEDIFKKDFEDIVTKNSFEKFLEIFKKELFKNIENSENNYLKVKNFILNVDNFSDKKEEKEIQIEIIKNYLDSNLNIYRMMKYFALEKEKQNLEGEFEANPEFYDKFKKFYIDNEIIQYYNEFRNFLTKKPYSEEKIKLNFENGSLIDGWDKNKEPDNYGTILRKNGKYFLALQVYKKKNIFYNKKSSSVEDVKEAYDLKNGESFFEKVDYKFFPDASKMIPKCGVQIKEVKNHFLKNDNDIILERGVNIKKDSNIVVPLLITKNIFELNNFEYKKSYLESCGENFDINQRVAADSKKQNQIKIFQKDFYKLTGNYDLYRKSLNTWIDFCQRFLDSYSSTKEFNLKFKKPEEYESLDKFYDYVNKNTYSISFRKVSEKYIYDNVKRGNIYLFEIYNKDFSSYKTGKENLHTMYFKGLFEENNLKNIVLKLNGQAEIFKRKSSLEKRIDSKRKVNKDIIDHKRYTKEKLFFHCPISLNFSNNTNDINAKILEYLNKNEEINIIGIDRGEKHLAYFSVIDQKGNILKDENGNLVKGSFNTIELFGKDNKKIGEKNYYEELVKRENERKQARGSWKTIGNIKDLKQGYISQIVHKLSELIIKYNAIVIFEDLNSGFKRGRQKIERQIYQKLEKALIEKLNYLTFKDRSFGENGHYLSAYQLTEPFETFEKIGKQTGVIFYTDPSYTSTTCPKCGFRKDLYLKYSNLKNAIGDIEKIDSITFEGNKFIFEYKGKKVFSNRDRKRNISSEERDVKGWITVDNDITKNLIDLFEKFKINFSNGENIILQIQEKNEKELYKKLFENFNAILSIRNSTIGDNSRSGDFICCPCCDFDSRVDNEIGIENGDDNGAYNTARKGIIILEKINLAFKKYNDVKKIKWKDISVTQEDWDKLKK

SEQ ID NO: 87 - protein, 1236 aa, unidentified
MRKIFDLVAQYALSKTLRFEIKPSKITRQNLETQKILIQDTKKQKAYQELKPLFDALHNKFIAESLENSQINWESYFDHLKAKKSDFSDSEKKKWEKDFEKIEKNLREEIGKLYEKTAERWKLEINENPKKPILKDKSYKILTESGILKVLKKIFPDKQEFIDEFEGFFTYFSGFNQNRENYYTTKEEKSTAIATRIVHENLPKFVANREAFKKHEEKYLEMYDKLNSKSRQIRDKKTGEMINISAITEDIFEIPFFNRALSQAGIDDYNRLIGHYNELINLYNQEFGEKLPLFKILYKQIGSLHEKGFEIFQIENANHLKNILQNNYFPECNQKNEQILQLFQSLEKHENLKEIYLSKIAINTISAKFFSNWFAFAEILKNQKIWKMSSEGQIEATEYTSLADILEALKNLKPVEIFKNWEDEKNLQNLGSDNIFLKKLIDEVRISIENTQKYEGELHNILKNFSISKKNDREILKKYADESRIPAIMAKYFLAKKMEKSGIDAEFYNELHTILEDYKIVEYYDAIRNFITKKLESPEKMKLNFENGTLAGGWDVNKEVDNSCILLKNEKDEEFLAIMSRGNNHIFEKEIGTRKQKMKNPLYENVAQNGWKKMEYKLLPGPNKMLPKCLFPKSNRKQYGATDEILAIYDEGLFKKGENFSKEALHKIIDFYKQGIQLYENWQVFGFQFKKTEEYEDISQFYADVEKQGYKLDFVPINGEKLLELEREGKIFLFQIKNQDYNEKPGKSQKNLHTLYWKNIFENVPNRVKLNGEAEIFYRKAYEPTFKKDENGNEILNKKGEKIIDKLRFTREKFLFHVPVTLNFCMKNTNINEQVREIIIQNPDITFLGIDRGEKHLLYYSLIDRNGNIIEQGSLNCIGKTNYAEKLTQVANNRDEARKNWQTIGKIKELKEGYISHAVKKIVDLSIQHNALIIMEDLNTGFKRSRQKIEKSIYQKFELALAQKLNFVVMKDALQNTHGSVNQAYQLTPKIDNYGDIEAKKQVGIIFYTRANYTSQTDPATGWRKSIYLKKGTENTKNGILENFSDIIFENGDFIFSYTDKNTGKHWELHSQINGENIERYYHERNKETGQWENSKVNINNLLLTTLENFDFNRSILSQIDKGVEPKSWEKLRFAIEMIQQIRNTGMDAISDDFLLSPVQKEQGEHFDSRKFLQKIQNELVPNSEKFPTSGDANGAYNIARKGIIMIERIIKYNKTLNGKVDLLIKDIDWDMWLLR

SEQ ID NO: 88 - protein, 1293 aa, unidentified
MAKENIFNELTGKYQLSKTLRLELKPVGNTQQMLKDEDVFEKDRIIREKYRETRPHFDRLHREFIEQALKNQKLSDLGKYFQCLAKLQNNKKDKEAQEEFKRISQNLRKEVNDLFKIDPLFGEGVFALLKEKYGEKDDAFLREQDGQYVLDENKKKISIFDSWKGFTGYFTKFQETRKNFYKDDGTATAVATRIIDQNLKRFCENIQIFKSIQKKVDFKEVEDNFSVDLEDIFSLGFYSSCFLQEGIDVYNKILGGEPKTTGEKLRGLNELINRYRQDHKGEKLPFFKMLDKQILSEKEKFIESIEDDEELLKTLKEFYSSAEEKTTVLKELFNDFIKNNENYDLSEIYISREALNTISHRWVSAATLPEFEKSVYEVMKKDKPSGLSFDKDDNSYKFPDFIALSYIKGSFEKLSGEKLWKDGYFRDETRNGDKGFLIGNESLWTQFIKIFEFEFNSLFEAKNTERSVGYYHFKKDFEKIITNDFSVNPEDKVIIREFADNVLAIYQMAKYFAIEKKRKWMDQYDTGDFYNHPDFGYKTKFYDNAYEKIVKARMLLQSYLTKKPFSTDKWKLNFECGYLLNGWSSSFNTYGSLLFRTGNEYYLGVVNGSALRTEKIKRLTGNITEANSCHKMVYDFQKPDNKNVPRIFIRSKGDKFAPAVSELNLPVDSILEIYDKGLFKTENKNSPFFKPSLKKLIDYFKLGFSRHASYKHYQFKWKDSSEYKNISEFYNDTIRSCYQIKWEELNFEEVKKLTNSKDLFLFQIYNKDFSEKSTGNKNLHSIYFDGLFLDNNINAQDGVILKLSGGGEIFFRPKTDVKKLGSRTDTKGKLVIKNKRYSQDKIFLHFPIELNYSNTQESNFNKLVRNFLADNPDINIIGVDRGEKHLIYYAGIDQKGNTLKDKDDKDVLGSLNEINGVNYYKLLEERAKAREKARQDWQNIQGIKDLKMGYISLVVRKLADLIIEYNAILVLEDLNMRFKQIHGGIEKSVYQQLEKALIEKLNFLVNKGEKDPERAGHLLRAYQLTAPFSTFKDMGKQTGVLFYTQASYTSKTCPQCGFRPNIKLHFDNLENAKKMLEKINIVYKDNHFEIGYKVSDFTKTEKTSRGNILYGDRQGKDTFVISSKAAIRYKWFARNIKNNELNRGESLKEHTEKGVTIQYDITECLKILYEKNGIDHSGDITKQSIRSELPAKFYKDLLFYLYLLTNTRSSISGTEIDYINCPDCGFHSEKGFNGCIFNGDANGAYNIARKGMLILKKINQYKDQHHTMDKMGWGDLFIGIEEWDKYTQVVSRS

SEQ ID NO: 89 - protein, 1322 aa, unidentified
MTGIFKDFTHLYELQKTLRFELIPVGRTKELLEKNHVFEKDEKIAENYKDVKKYFDRLHKEFIKDAFSHTNLPENLLEGYEQKYFSHKLNPSRASRIDLEKIAKRLRTILLKSFNTEADQWKNRYLKNIEQTLKNKNEKQQKKELEKKLKKIKEGTKGIELFFKVEVFDFLKYKYPEAQINGKSIFDPFNKFGCYFKKFHETRINFYKDDGTSTAIPTRIINDNLSIFLENKKIFESKYSKKHKSVFAKNELRIFVLFYFNNCFSQKQIDGYNNTIALINSNVNQLRQNNPEVSKKDLPFFKRLFKQILSQPSKQEIEQDSFIEIFQDEDVFPTMQKFINENKICIPKAKSIFKKFISSQKVKSDEYNISQIYVAKRFINTISNKWFSNWNTIRNLLIPKDKKNIPDFISVTSLKAALQKTQNIVEVNDLFRKEYRDILEEGSDFYQIFLKIWEKEFEKATDIYLNETKEIEKMITEDKKYLPNKKGRLKSGKKGSIQKEKFLDYTQSVFDIYLMMKYFSLEKGKERVWNPEALDEDAIGGFYEKFKEYYENINTWKYFNVFRNYLTKKPYNSEKIKLNFECSSLLSGWSKNYDSYGALIFEKNEKYYLGIINGTKFTKDEIEQLYLDIRNNNISLRLVYNYQKPDFKNFPKLFIRSSGSNFAPAVKKYNLPIDSVLNIYDKGLFKTSNKSSQNYHESLKKIIDYFKLGISQHESYKGFSFKWQETSEYDNISDFYKDATRSCYKVTWENINFSKLYELIESGRLYLFQIYNKDFELDENIAPKGYNFKDKNGRRNLHSIYWKALFSNTNFKKTILKLNGGAELFYRKLTKNLTKDPIITVKNQIKIIKKNNNIFHKKRFTQNKIYFHCPVSINFTENDWKINTKICNTIRNNSKVKIIGIDRGEKNLAYYSVIDHQGNILETDSFNEVQEREDREPTDYQKKLDQIQKERDWQRKSWQEISSIKEMKKGYISQVVHQICKLIRKYEAIVVFEDLNIGFKRGRFAIEKQIYQNLELALAKKLNYMVFKDAKEEETGHFLQAYQLTPPVINFQDIGKQCGIIFYVPASYTSAICPACGFRKNISTSVEKIEKNIDLINKFNIVYDPDKDRFCFRYKRSDFIKSEKEKEDDSKVKLYSNTKLPDDFTFYSNVERFKYIRDQNNRGGKVELKYPNDSLKKLFHENGINFQNFSNISQLIKTRNFENENFYKPFIYIISLILQLRNTTIEINQNENNEKYRDFISCPHCYFHSENNLITLTKRYKGKKPFEFNGDANGAYNIARKGILILQKINKAKRLEEIEYGGLTVTQQEYDKYLALVSSKKA

SEQ ID NO: 90 - protein, 1322 aa, unidentified
MTGIFKDFTHLYELQKTLRFELIPVGRTKELLEKNHVFEKDEKIAENYKDVKKYFDRLHKEFIKDAFSHTNLPENLLEGYEQKYFSHKLNPSRASRIDLEKIAKRLRTILLKSFNTEADQWKNRYLKNIEQTLKNKNEKQQKKELEKKLKKIKEGTKGIELFFKVEVFDFLKYKYPEAQINGKSIFDPFNKFGCYFKKFHETRINFYKDDGTSTAIPTRIINDNLSIFLENKKIFESKYSKKHKSVFAKNELRIFVLFYFNNCFSQKQIDGYNNTIALINSNVNQLRQNNPEVSKKDLPFFKRLFKQILSQPSKQEIEQDSFIEIFQDEDVFPTMQKFINENKICIPKAKSIFKKFISSQKVKSDEYNISQIYVAKRFINTISNKWFSNWNTIRNLLIPKDKKNIPDFISVTSLKAALQKTQNIVEVNDLFRKEYRDILEEGSDFYQIFLKIWEKEFEKATDIYLNETKEIEKMITEDKKYLPNKKGRLKSGKKGSIQKEKFLDYTQSVFDIYLMMKYFSLEKGKERVWNPEALDEDAIGGFYEKFKEYYENINTWKYFNVFRNYLTKKPYNSEKIKLNFECSSLLSGWSKNYDSYGALIFEKNEKYYLGIINGTKFTKDEIEQLYLDIRNNNISLRLVYNYQKPDFKNFPKLFIRSSGSNFAPAVKKYNLPIDSVLNIYDKGLFKTSNKSSQNYHESLKKIIDYFKLGISQHESYKGFSFKWQETSEYDNISDFYKDATRSCYKVTWENINFSKLYELIESGRLYLFQIYNKDFELDENIAPKGYNFKDKNGRRNLHSIYWKALFSNTNFKKTILKLNGGAELFYRKLTKNLTKDPIITVKNQIKIIKKNNNIFHKKRFTQNKIYFHCPVSINFTENDWKINTKICNTIRNNSKVKIIGIDRGEKNLAYYSVIDHQGNILETDSFNEVQEREDREPTDYQKKLDQIQKERDWQRKSWQEISSIKEMKKGYISQVVHQICKLIRKYEAIVVFEDLNIGFKRGRFAIEKQIYQNLELALAKKLNYMVFKDAKEEETGHFLQAYQLTPPVINFQDIGKQCGIIFYVPASYTSAICPACGFRKNISTFVEKIEKNIDLINKFNIVYDPDKDRFCFRYKRSDFIKSEKEKEDDSKVKLYSNTKLPDDFTFYSNVERFKYIRDQNNRGGKVELKYPNDSLKKLFHENGINFQNFSNISQLIKTRNFENENFYKPFIYIISLILQLRNTTIEINQNENNEKYRDFISCPHCYFHSENNLITLTKRYKGKKPFEFNGDANGAYNIARKGILILQKINKAKRLEEIEYGGLTVTQQEYDKYLALVSSKKA

SEQ ID NO: 91 - protein, 1275 aa, unidentified
MKKENIFENFTHQYSLSKTLRFELIPTEETKRFLEKNEIIKKDAVIDESYHKAKPYFDSLHREFIKESLDPERSLLSFGNFERSWNDFQKDKKSNKKNLLAQKKLLYKDIAKLFDDYVNTWKKQYAPETKNSGTKLLYSADTLSILKKRFPKDSENEKLFIKDEHGNDRYIFDSFDRFTTYLTKFQATRENLYKNDGTSTAVATRIVENLSFFLANKSKFEKFLAYKDILKLTDQEKESSKTEYYMRCMTQPGIEKYNALVGDLNARMKTLRDTAGKDAKKSDYPLLKKLYNQILAEKKIESDKVFDIESNEEVPVRMHEFYEEVERVSTIAKELVTILAQGGFENEYGGIYLHNRAINTIARKWFVSAYEFENCLPQKGKKKEGSVRVAPFVSFAEIKDALGEKLAEDLLKEKLFEEKAYRLVKRTLAYSQFLALFAKDLEILLNEYNEKKNNFSKKDLRIFERGENDENVDALKDALDAGLHIVQFMKYFVLSSKKADDKPTHTSAEFYNHYDELYGDPDQKHDIVRYYDAFRNFLTKKPADQKKIKLNFENGALLTGFDKDKESEKLGIILRKNSIYYLGIINKEHNKIFDDKKHQDAFDVVDATSYEKMEYKLFPDPKRMVPKIAFAKKNRERFGWTQEIQDIKDEYARFQDDRGDRSNWSKQFDKIKLTKLIAYYQHALDRGGYKNTFDFQWNNPVDYSGIGEFNDHLTSQNYKIGFRQVRQRYIDDKVAQGELYLFKIHNKDFGEKSKGTQNTHTLYFLNLFSQHNLTHIKLRLAGNAEVFYRKSSTQRKEEQRKFIRPIVKNKRFTEDKYFFHIPIKIGASVNSISETKFNRTLNEKLRQSACLIIGIDRGEKHLAYYSVINQKGEIVDQASLNKINDVDYCEKLRTREKERLEQRKSWKAISQIKDLKRGYISQVIHKLSELVIKHNAIIVFEDLNMRFKEVRGGIERSAYQQLEKALIEKFGYLVFKDKDPLEAGGVLNGYQLSAPFESFEKMGKQNGVIFYTNPEYTSTTDPVTGWRQHIYIKSDATDNEALKVFTEKIGIGWSDDKQSYTFSYDQKDFWEDSPARKWVLYANAPRLERYRNDAGYWTTRETNSNDLLRELFEVWDFDQPEGDISEQIAMMYEEGKLKGEKIISEKSQRFFKALRYALNLTQQIRNSDSIRYVYERDAQGDIVEDSQGKMVVKEIGENVDFIASPVVPFFTTPNPYTKENLCGLVIENGDANGAYNIARKGIMMLERIKQTQANPDLYISKSDWDEWLMKDIKQK

SEQ ID NO: 92 - protein, 1327 aa, unidentified
MSQKNIFEGFTRKYALSKTLRFELKPVGNTLQMLEDENVFEKDRVRKEKYKQTKSFFDRLHRQFIIESLTGKTIDGLDKYFTLLKKLEKDKKDKALQKEFKTLSEELRTQLNNHFQTEALFGVSVFEELKKRYGKEEGSFLKDKKDELVLDEEGNKISIFDEWKGFTGYFDKFQETRKNFYKDDGTSTAVVTRIIDQNLKRFCENTQLFKDIKYKIDFSEVEKTLSVDLGVVFSLEYYNSCLLQDGIDTYNKILGGEVVKDTNEKLKGLNEIINKYRQDHKDEKISFFKLLDKQILSEKEDFIENIEDDKELLQRLREFYISAEEKTEVLKTLLGDFFLHEEEYELDKVFLSKEGLNTILHRWMTDNGRDEFQKVIYEQTKKDKIVKFEKSDNSYRFPDFIALSLIKNALAKSFEEEKLWKDKYLKNEEDSKSKGFLSGEEPKWEQFIKIFESEFNSLFENEYQELIGGEERQVKKGYNVYKKDFEEIINRNESDFSVSSEDKLTIKNFVDSTLWIYQMGKYFALEKKRQWVGDEYDIDTKFYHHPDFGFKKKFYDDAYGKLIKVRMLLQSYLTKKPFSTDKWKLTFENPTLADGWDKNKEPDNSAVILRKDGRYYLAVMQKGHNKVFDDGNIQASGTDSYEKMVYKSISDPVKDIPNLMVIDGRTVRKTGRKDKKTGINHRLEELKDEHLPKEISDIRKSSSYLKTSENFNQEDSQKYLAFYMQRLIEYKKGEFDFEFKKPEEYGSYAEFLDDVGNQGYKIDFVGVSSEYIKNKNTSGELFLFEIHNKDWGSGPKDKNRKRTKNLHSMYFDTLFSKENAESNFPFKLNGEAELFYRPKTDEEKLGYKVKNTKTGKWKNIVVKKSESVPEEAVVDHKRYLKNKTFLHVPITLNRTADDSHYFNQKVNEFLLNNPEINVIGLDRGEKHLIYYAGIDQKCNLLKDKNGNTALGSLNEINGVNYHKLLEERAKGREKARQDWQNIENIKDLKKGYISLVVRKLADLIIEHNAIIVFEDLNMRFKQIRGGIEKSVYQQLEKVLIKKLNFLVNKGEKDPQKAGHLLRAFQLTAPFITFKDMGKQTGVIFYTQASYTSKTCPECGFRPNVKWDQDGLMEKINITFTENNFKIAYKASDFLKQKNSSKRGNRLYADKKGKDEFILSTKNAIRYKWFSRNKKDFELKKGEERMLEQTENGITIKYDITECLKGLLEEQDIDYKNNIVKQISEKVATKKFFTELAYYLYLLSNTRSSVSGTNIDQINCPHCGFHSDKKFNGVDFNGDANGAYNIARKGVMILEKINQYHNVNKTLDKMNWGDLFIDIEEWDKHTQD

SEQ ID NO: 93 - protein, 1334 aa, unidentified
MKTFENFTNLYELNKTLRFELKPIGGTKELIEEKHILKLDKEKRENYEKVRPYFNKIHQEFINFALKNPNFDFLKHKEKYLNWLKDKKNKDLLKEKEKIDKIFLEKIGELFENSVKDFLKENGFESIIKQEDQDLKFFRRKEIFEVLQEKYGSELETQIIGKDGETKSIFSGWDKWLGYFDKFFNTRDNFYKTDGTSTAIATRIIKDNLKIFLENTIIFEKVKNKKIDFSEVEKNFSINIDSFFEINNFNNYFLQDGIDFYNKIIGGETLENGKKLKGLNEIINKYRQDTGDKIPYFKKLQKQILSEKDGVFIEKIEDDGGFYDILKKFYENAVEKEGFLRNIFENFYGIGDENLEKIYFNKVAFNTISHKFGNAQEFEKILYEEMKKSKVDGIKFEKKENKYKFPDFIQIIFIKKALENYDSENLFWKERYYKSEENTDGFLERNNKNLWEQFCKIFKFEFLNILKRKIIDDAGEEHEVGFDISKEILGKKLENFELNQENKGIIKDFADYALVLYSFGKYFAVEKGRNWDPNTEDIDDEFYKGENGYIEKFYDTGYDEIVKPYNLMRNYISKKPWEDSKKWKINFETSSLLSGWDKNLESNGSYIFQKGNKYYIGIINGSKPAKEVLEKLYSGNGEKIKRFIYDFQKPDNKNTPRMFIRSKKDSFSPAVGKYNLPVEDILEIYDNGLFKTENKDNSNYKESLSKLIDYFKLGFSKHESFKHFNFVWKDSKEYENIADFYRDVEKSCYQITSEFLDFEELKKLTFKKHLYLFQIYNKDFELDESLQKNGYNFRDEGQKNIHTKYFEALFLEENILRKSGAVFKLSGGGEVFFRKESIKAEKEKRKNIEVTKNRRYTEEKYFLHFPIQVNFKNEISGNFNQEINKFLANNPDINIIGIDRGEKHLAYFSVINQKGEILESGSFNKIENYDKNGEKILYSEREIKKTYKDGKLIDLELVETGKKVDYVDYKLLLEYKEEKRILQRQSWKEVEQIKDLKKGYISLLVRKIADLIIKYNAIVIFENLNFRFKQIRGGIEKSIYQQLEKALIDKLSFLVNKNEINLEKAGSLLKAYQLTVPVDSLKEIGKQTGVIFYTEAAYTSKIDPITGWRPNLYLKKNNSKINKENILKFDNIIFNSKENRFEFTYDLKKFLGKDAKFPEKTIWTVCSCVERFKWNKFLANNLGDYDHYEDLTDGKLLNRALKEGEFSNFKELFKKYLIDINGNILEQIKNLDTKNNERFFSEFINLFSLICQIRNTNQKEKGDENDFILSPVEPFFDSRKSKKFGKNLPKNGDENGAFNIARKGLIILDRISQNPEKTDLLILNSDWDNFVRNA

SEQ ID NO: 94 - protein, 1231 aa, unidentified
MTKNPFSTFTNLYPVQKTLRRELKALNADFQPDASLTALWAAEIPSQDQQREADYQAIKPLLDELHHQFISESLQELPEQNWSDFVSFYQDYQQNKKRKADLDEKTIKTLDEDFKTRTGAFRKAIGEAFAATAEQRKANPAYCNEKGKAFLSQKSYKILTEQGILSVLEQKYSDQSEKLDLIRRFGNFFTYFTGFNQNRENYYSTEEKSTAVAYRTINQNLLTFANNCELFEALQVLDLSAQEQKIFTPDSYSDYLVQEGIQHYNEQIASIKSKINLYIQQHKTKLPQPKELYKQIGAPVIKQIPFDLINNDEEFLAVMEQFIEQTNAKLPLMEQLFTQLSSGMLDLNQLFFSKSALNQLSNRYFANRHLLLEKGVELKLFKYQKNAEESYKLPAYVSLAQLKVLLEALPATWIQEGQTIGLFKTQRAQEGISNWETLMQALQSDFSSFCHGTQERTDEEGKTHALLSYNAALSKRKALSKFEKNNQEQKNLIKAMGDSALGALRMLKRLRIDTDKLGFVPEGEFYHRYDEILEEYPLPKRYDMIRAYLTQKPYSQKKLKLNFQSSTLLAGWDKNKETQNLSVLLKRGELRYLAIMKKDQNKFFENAQLYQNPSGGREKMDYKLLPGANKMLPKCLMPGKDKKKYGASDEILELYQKGSFKKSEKSFNLLDLHRLIDFYKSALPKYEDWQVFDFQFQPTEAYQDISQFYREVEQQGYLLNWRGVNEEILKKGIENGSIFFFQISSKDFSGNSSTPDLQTLYRKQIFAPHSQVKLNGEAEIFLRKASFAKEKKTLKHDHFEVIKHRRYTEDKLLFHVPITLGFGNAQIAGNQFSKFNQKLNQELLIPHFDDLHVIGVDRGEKHLAFYSIVHAKTGKLVKQGTLNLINGVDYEQKLKEKADSRLQARQNRDTIEKIADLKEGYISQIVKKLTDLMLEYNAVIVFEDLNGGFKRGRQKIEHSVYQKLELALAKKLSCLIRKETPMGEPGSVAQPYQLAPAITTFGDIKGKQRGTIFYTRANYTSTTDPLTGWRKQHYFKKASAEEMKKQFLSTFKALHRDGTAYVFDDGTWQLYSNVERWRGKRNDHWQRIPTKYDPTAELESLFAKYQIKKTDPLLAQLKDRDLPQAFWLSLFRILDLIMQIRNTDEQGRDIILSPVGKEGERFDSRQRYDQLPHNEQGVVIEESCLPYPTSGDANGAYNIARKGVMMLQRIKESPEKPDLLIRDAEWDSWII

SEQ ID NO: 95 - protein, 1367 aa, unidentified
MSVFKSFTNCYALSKTLRFELKPVGKTFENMRTQLAYNKDLQTFLKDQAIEDAYQKLKPLFDKLHEEFITDSLDSDQAKKIDFSEYLVLYEAKKELQAIEKKLREEIGKTFIAAGEKWKQEKYAQYTWKKGSKVANGSDILLTQDVLELIRDLNDKNEELKKMIEETFKGFFTYLSGFNQNRKNYYTIKEEKATAVATRIVHENLPKFCDNILFFIDRQTEYPIAHSFLKEKGRDLVNKDGKALLPITDSIFSIEHFNHCFSQKQIEAYNAQIGNANVLINLYNQAHNDEQGFKRLPAFKTLYKQIGCGKRKSLFFTLTCDTEAEASKMRNENKEAFSVEEVLNLAYKAGEKYFQNSIENDSNLTIPKFCSYIEAQQDYDGIYWSKAALNTISNKYFANYHVLKDRLKEVKVFQKAAKGSEEDVKIPEAIELEGLFAVIDEVDGWRDEDIFFKKSLIEERKDEKENKKNKKRLEVIKKAEKPSQALINLIFFDINEHIEQFFDTSKAILSLQEYKSKESKEAIKAWMDHALAVNQILKYFLVKEDKTKGNPLDSEISNALKNILFEGKIIFDGKEIDVDWFRWYDALRNYLTKKPQDDAKENKLKLNFRNSTLAGGWDINKEPDNYCVILQDQNDKQYLGVIAKKEKQRGYNKIFEKTPENPLYKIDSGEVWQKMEYKQIAAPTGIGGFVRKCFKTAQQYGWKCPDNCLNSEGKIIIKNDEAKENLEAIIDCYKDFFIKYEKDGFSYKKFSFNFKKSSEYEELNNFFSDVERQGYKLDFTTINKAIIDQWVEDGTIYLFEIKNQDANDGKKEGHKNNLHTIYWKALFENNEDKPKLNGGAELFYRKALPKSKQEKIKDNHGKEIIKNFRFSKEKFLFHCPIKMNYKAKSYSDPKYALPEINNQINEALTTFGDIHFLGIDRGEKHLAYYWLVDKNGEMIDQGTLNLPFIDQEGKPRSIKKPKYFYNKKKDKWESEEINCWDYNDLLDAMASNRDMARKNWQTIGTIKELKEGYISQVVRKIADIVVEHGAFIVLEDLNTGFKRGRQKIEKSVYQKFELALAKKLNFLVDKSAKSGEIGSVTRALQLTPPVNNYGDIEKRKQVGIMLYTRANYTSQTDPETGWRKIIYLKKGNEEAIKEQILQNFTDIWFDGLDYYFEYPNKNKSDKPWKLYSGKGGKSLDRFRRSRGKDKNEWTIEPVNVVNILKQVFVNFDEKRSLRSQIIEGKALARTKEKTDFTAWEALRFAIDLIQQIRNTGNNEKDADFLHSPVRDTNGNHFDSRSVSHDRPTSGDANGAYNIARKGLMMNEHIRTWAKKGKPKYDKNTNDLNLFISEEEWDLYLADKKAWQEKLLMFSSRKAMDEEKKKHI

SEQ ID NO: 96 - protein, 1367 aa, unidentified
MSVFKSFTNCYALSKTLRFELKPVGKTFENMRTQLAYNKDLQTFLKDQAIEDAYQKLKPLFDKLHEEFITDSLDSDQAKKIDFSEYLVLYEAKKELQAIEKKLREEIGKTFIAAGEKWKQEKYAQYTWKKGSKVANGSDILLTQDVLELIRDLNDKNEELKKMIEETFKGFFTYLSGFNQNRKNYYTIKEEKATAVATRIVHENLPKFCDNILFFIDRQTEYLIAHSFLKEKGRDLVNKDGKALLPITDSIFSIEHFNHCFSQKQIEAYNAQIGNANVLINLYNQAHNDEQGFKRLPAFKTLYKQIGCGKRKSLFFTLTCDTEAEASKMRNENKEAFSVEEVLNLAYKAGEKYFQNSIENDSNLTIPKFCSYIEAQQDYDGIYWSKAALNTISNKYFANYHVLKDRLKEVKVFQKAAKGSEEDVKIPEAIELEGLFAVIDEVDGWRDEDIFFKKSLIEERKDEKENKKNKKRLEVIKKAEKPSQALINLIFFDINEHIEQFFDTSKAILSLQEYKSKESKEAIKAWMDHALAVNQILKYFLVKEDKTKGNPLDSEISNALKNILFEGKIIFDGKEIDVDWFRWYDALRNYLTKKPQDDAKENKLKLNFRNSTLAGGWDINKEPDNYCVILQDQNDKQYLGVIAKKEKQRGYNKIFEKTPENPLYKIDSGEVWQKMEYKQIAAPTGIGGFVRKCFKTAQQYGWKCPDNCLNSEGKIIIKNDEAKENLEAIIDCYKDFFIKYEKDGFSYKKFSFNFKKSSEYEELNNFFSDVERQGYKLDFTTINKAIIDQWVEDGTIYLFEIKNQDANDGKKEGHKNNLHTIYWKALFENNEDKPKLNGGAELFYRKALPKSKQEKIKDNHGKEIIKNFRFSKEKFLFHCPIKMNYKAKSYSDPKYALPEINNQINEALTTFGDIHFLGIDRGEKHLAYYSLVDKNGEMIDKGTLNLPFIDQEGKPRSIKKPKYFYNKKKDKWESEEINCWDYNDLLDAMASNRDMARKNWQTIGTIKELKEGYISQVVRKIADIVVEHGAFIVLEDLNTGFKRGRQKIEKSVYQKFELALAKKLNFLVDKSAKSGEIGSVTRALQLTPPVNNYGDIEKRKQVGIMLYTRANYTSQTDPETGWRKIIYLKKGNEEAIKEQILQNFTDIWFDGLDYYFEYPNKNKSDKPWKLYSGKGGKSLDRFRRSRGKDKNEWTIEPVNVVNILKQVFVNFDEKRSLRSQIIEGKALARTKEKTDFTAWEALRFAIDLIQQIRNTGNNEKDADFLHSPVRDTNGNHFDSRSVSHDRPTSGDANGAYNIARKGLMMNEHIRTWAKKGKPKYDKNTNDLNLFISEEEWDLYLADKKAWQEKLLMFSSRKAMDEEKKKHI

SEQ ID NO: 97 - protein, 1338 aa, unidentified
MAKEKSIFDDFTRKYALSKTLRFELKPVGKTLENMREHLRYDAKLQTFLSDQEIEDAYQTLKPVLDFLHEKYINESLESKTLKEVDFSSYLKKYRDRKKLSEKDFEPVCKELREYFKKAFEDTAEGWKTSAGKDKKDKPLLSEDGFKILTEKNILEYIRRNVDTFASLRSKEEIEEALKAFEGFFTYFGGFNKNRENYYETGKEAATAVATRVVHKNLPGFCDNILFFEDKKEDYKGIHSYLGKLGKNLVTKDGKPLVPISENYFRTQHFNSCLSQTGIEQYNGEVIGNANFLINLYNQSRGGEKGFKKLSLFKTLYKQIGCGKRVSLFFTLTHDTKAEAEKDRKEKKSDAFSVEEILDLAEKAGEKYFRGKSDDGTINTVSELLENISSRENYEGVYWSKIALNTISNRYLANWHQIKDKLKDAKIFKQKGKSLEDDIQIPDAIELERLFEVIDSVQGWEKKDIFFKPSLTEEKKDVHEEKKNKKRRQIIANAGKPSRALLKLLFLDIEDHAENFLAQTKIVRQIQKYKDPKSKETIKLWMDHALAVSQMLKYFLVRENKAKGAPLDATIVEALKTILRSDDVDWFGWYDALRNYLTKKPQDDAKENKLKLNFENSTLAGGWDVNKEPDNYCVIFQNSENEQFIGIIAHQENTRGYNKIFERTGNNPLFVEKSQWKKMEYKLLPGPNKMLPKCLLPTTDRKKYGASEEVLAIYDKGSFKKNENNFSPKDLSILIDFFKTAIKKYENWQCFDFAFRPTSQYEDISQFYSEVEKQGYKLDFFGIDKLYLEKLVNDGKVYLFQIKNQDYNDGKKKGHKNNLQTLYWEAVFKETENHPKLNGEAELFYRKPVPADKLVKVKNKEGKEIIKNFRFSKEKFLFHVPVTLNFCHKDNRISHLVNTKLVPKENLLFLGIDRGEKHLAFYSLVDKGGNIKEQGTLNIPFVDKDGKPRTIKAEKRSIKNGKEGVEVVECKDYNELLEARAGDRDYARKNWQTIGTIKELKDGYISQVVRKIVDIAVAHGAFIVLENLNIGFKRGRQKIEKSVYQKLELALAKKLNFLVDKNAEIGEVGSVTKALQLTPPVSNYGDIEGRNQIGIMLYTKADYTSQTDPVTGWRKSIYLKKGSEEDIKRQIADSFSDITFDGKDYCFIYTDKNTRKLWKLYSGESGKSLERFRREQNRNTGEWVSTPQDVTKNLSKLFTSFDLNKSLHSQIVDEGVELVKMDEHTAWESLRFTIEMIQQIRNTGVKKEDSDFILSPVRDENENHFDSRKAKSNEPDSGDANGAFNIARKGMIMNEHIKLGLGLYISDEEWDAWLAGKQVWGKWIIENGEKLKKKSRSL

SEQ ID NO: 98 - protein, 1367 aa, unidentified
MSVFKSFTNCYALSKTLRFELKPVGKTFENMRTQLAYNKDLQTFLKDQAIEDAYQKLKPLFDKLHEEFITDSLDSDQAKKIDFSEYLVLYEAKKELQAIEKKLREEIGKTFIAAGEKWKQEKYAQYTWKKGSKVANGSDILLTQDVLELIRDLNDKNEELKKMIEETFKGFFTYLSGFNQNRKNYYTIKEEKATAVATRIVHENLPKFCDNILFFIDRQTEYLIAHSFLKEKGRDLVNKDGKALLPITDSIFSIEHFNHCFSQKQIEAYNAQIGNANVLINLYNQAHNDEQGFKRLPAFKTLYKQIGCGKRKSLFFTLTCDTEAEASKMRNENKEAFSVEEVLNLAYKAGEKYFQNSIENDSNLTIPKFCSYIEAQQDYDGIYWSKAALNTISNKYFANYHVLKDRLKEVKVFQKAAKGSEEDVKIPEAIELEGLFAVIDEVDGWRDEDIFFKKSLIEERKDEKENKKNKKRLEVIKKAEKPSQALINLIFFDINEHIEQFFDTSKAILSLQEYKSKESKEAIKAWMDHALAVNQILKYFLVKENKTKGNPLDSEISNALKNILFEGKIIFDGKEIDVDWFRWYDALRNYLTKKPQDDAKENKLKLNFKNSTLAGGWDINKEPDNHCVILQDQNDKQYLGVIAKKEKQRGYNKIFEKTPENPLYKIDSGEVWQKMEYKQIAAPTGIGGFVRKCFKTAQQYGWKCPDNCLNSEGKIIIKNDEAKENLEAIIDCYKDFFIKYEKDGFSYKKFSFNFKKSSEYEELNNFFSDVERQGYKLDFTTINKAIIDQWVEDGTIYLFEIKNQDANDGKKEGHKNNLHTIYWKALFENNEDKPKLNGGAELFYRKALPKSKQEKIKDNHGKEIIKNFRFSKEKFLFHCPIKMNYKAKSYSDPKYALPEINNQINEALTTFGDIHFLGIDRGEKHLAYYSLVDKNGEMIDKGTLNLPFIDQEGKPRSIKKPKYFYNKKKDKWESEEINCWDYNDLLDAMASNRDMARKNWQTIGTIKELKEGYISQVVRKIADIVVEHGAFIVLEDLNTGFKRGRQKIEKSVYQKFELALAKKLNFLVDKSAKSGEIGSVTRALQLTPPVNNYGDIEKRKQVGIMLYTRANYTSQTDPETGWRKIIYLKKGNEEAIKEQILQNFTDIWFDGLDYYFEYPNKNKSDKPWKLYSGKGGKSLDRFRRSRGKDKNEWTIEPVNVVNILKQVFVNFDEKRSLRSQIIEGKALARTKEKTDFTAWEALRFAIDLIQQIRNTGNNEKDADFLHSPVRDTNGNHFDSRSVSHDRPTSGDANGAYNIARKGLMMNEHIRTWAKKGKPKYDKNTNDLNLFISEEEWDLYLADKKAWQEKLLMFSSRKAMDEEKKKHI

SEQ ID NO: 99 - protein, 1277 aa, unidentified
MFDQFTNIYSLDKTLRFKLNPVGNTPDLLEQNQVLKKDQTIENSYQQAKPYLDELHRRLINEALTPENLRNFPFNEYAAAYEYIKEINRNRYSANNKKETAASNEWESKKSDFRKAVVDMLNQQADHWKQKYQDLEFNKGELERKGTNFLTSPAINKILKTEFPPEKEQELVDKGFPSLHVDEEENSGEKRYIFESFDKFATYLSRFQQTRQNLYTSEDKATAIATRVVANFTTFMQNIHEFRDKHSSIEDELNLSQDEKRIFEPVSYRHYVLQADIEEYNAVIGDINKRMKELRDQKHKNPNYKKTDYPLLSTLDKQILGLQEKEHQLIEDDEDVWPCVEELLNISEQHFPALQKSVNALSETFFEPELPNIYLKDKNVNTISNRWFVNGDDFLIRLPQKNKKKDEKDTPKIKTFISLQDVRTAIDDMEGVLFKDRFYEEGAISPDQSTWQQFLGIFQHELSNAMEEYYQSARSLREVKDADPAFDKEHHTPVIKEFADACLRVYRLLDYFALTHRQSSQIPDVFSTEFYEEFDAHFYEVNVPRYYNALRDYIAQVFYGEDKIKLNFGKGNLLGGWSESRRNGAQYCGYILRRPQTNTYYLAITDNPWILDTEKHSEIKDTSNGMYEKMEYSQLKAQTIYGPSYEGEFGVSYDTDKQNSTNQKIIERVKRLLQKNFVEQYPELQTIIDREYSDADALAREVSNQNLYRISFVPVSAEYIEQGRYEAKRGGYNHLYIFEITNKDLAKPHSGGNPNLHTSYFLHLFSQENLSNPVLKLSGNAEIFFRPGNHDLPTKTDSLGKQVTTHKRYSKDTLLFHLPVSINFKKGSMKPKQFNDITNQKIADQPKDNLNIIGIDRGEKHLVYYSVVDCHGRILDQGSLNEINGIDYHRLLDEREKERIKNRQSWEPIEDIKNLKKGYISHVVHALSRLAVEHNAIIVMEDLNMRFKQIRGGIEKGTYQRLERQLIDKLNYLVFKDRDARETGGILRGYQLTAPFESFEKMGKQTGTIFYTEAGYTSVTDPLTGFRKNIYLKNSDTVENLKQAINTFHTIEWDEQRESYYFRYDVADFSKSKDTPSRIWEVYANVPRIIRKKVDERWTAAPVNPNDLLAELLQTYDFENPYGDVLEQIRIKEEAGELKGEREFDGEQRNFYKSLVYIFNLILQLRNSMSHKYRVENDSVITEGEDLDFIASPVPPFFTTESSYSTANFGGFEQRFIGNPQAREKFMEEFNGDANGAYNIARKGVLLLDRVRENPSNPDIFITNQEWDRAATEWDTS

SEQ ID NO: 100 - protein, 1304 aa, unidentified
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFNTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFEHSKLLGGFSESKTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKITLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 101 - protein, 1364 aa, unidentified
MNTTSEKKQLESIFDTFTNKYALSKTLRFGLEPTETTEKLLKENQIIGKDETIEKAYKNAKCYFDLLHQKLIRQAFSFEMNPNFSLSELENSYKEHSLLSNEERRKDATFFSIRKTAYSNVNKLLEDVALLWENEEKGKTSKKQGTKFLCSKDILNLLKKEFPKEMDVEFVGKDMPSLFVQDETGNSKYIFDAFDKINGYLSKFQETRSNLYLSGGEATAVSSRIVSNFLLFLDNKDVFKKIEKLSSSRFGLEDIKTEWLKDKEKVLWKKICLQEGIDEYNDVIGEINALVKKWRDVDGGQKFEYPFLKRLKKQVLSEVEARVDLIESYADLPERFAEFVEETEIRLGKTAWTLLENLFSKTYDQDLDKIYINAKAVNSLAFSCFSEPNEFMGTLTGKKNQDNPKPKAFTSLTEIVRAMEEIGGNDHARIFKDRWYSNSQTSSRIGIDETTEYKEQLFSLWKQQWNILFSGEVAKNRSDNVAIIGFNEALIGAKEVVAEGSFKKNPDIVKKIKTYVDCALDIHRRLSAFALEAKNENDIPQTNDISTEFYEDFNAVFRWYAGKEGKSIPITKKDGTIKMATVFDGRGMPLLVRYYNAFRNEITKQISDKDKLKITFNAGSFLGGWDKNKEGEKLGVIFRNADYFYLGVINKEISGDLFGSKKNSYWYEDVSDGKWEKMEYKCLGDAKRQIPRIAFSKKNKEILGCTKEIEKIKKEFEEFQKLKAKNKDFWSVSFDKDKLKKLIEYYQKCLDICGYREEYNLSFKKPGEYKGIGEFNDEITKKSYKISFVPINKDKLFEKEREGKIFLFRIFNKDWNLDAPNGNKKKTIKNMHTLYFENLFSTSGFEHLKMNGNAEMFFRKKIVTVETKKDKKENDVPNHKRFIVDRWLFHVPVKINWNPSGSQKKYNVQINNFLYQNLEDINIIGIDRGEKHLAYYSVVDQQGNILDMGSLNAINNIPYYDLLRARMKERLENRQSWNPIVQIKNLKRGYVGALAKKIADLAIRHNAIVVMEDLSFRFKQIRGGIEQSVYQQIEKALIDKLGYLVFKDRDANEIGGAMKGYQLTAPFESFEKMGKQTGIVFYTNAGYTSSIDPLTGFRRHIYMKVKNRRESFLKFEEIFWDEKEQSYCFRYDVAKFAYKKEEKLERIWSVYGKASRIVRTVNESGHWEPIPTSVDVLLEDLFKKYEFDERGDILSQMKSASEEDLSRKKSFQEGKRVKDRNFWERLAYLFSVACEVRNSLSREYRINEETGKAESVGEDVDFIASPVPPFFATRSDNPKGKCEENLAGFERRFDRFDGTKEEKQKCIREFNGDANGAYNIARKGIIILEKIRKYNNREGSAEKMEWKDLAVSNQDWDEYTSLKK

SEQ ID NO: 102 - protein, 1298 aa, unidentified
MNEDKKVFEKFTNLYSLSKTLRFELRPMGKTLENMKSKIGYGKNNDGFDTFLADQNIEDAYQILKSVFDRLHENFITESLESTEAKRIDFTSYFEIKEELLKTNRRENREEFDRYDKMLADEERELRRAIAKIYAVAGEKFKNRAGKEKSKDILKESGYKVLTEAGILKYIQNNIVEIVGWELKTPNGFLVDEEKLKKALEDMNKFFTYFSGFNQNRENYYSADDKATSVSNRIIGDNLPKFVDNIFSFEKNRDNYLGAFNFLKSKEKDLKLKNPKFGKEMEDEFLDAWKIDAEFFAINFFVNCFSQEEINKYNLQIANANYLINLYNQNKTDEMPKLSFFKILYKQIGCGEKKDFIKEIKDNNELKSILKDAKIEGEKYFVEKEGEEQKTVFSFCKYLLGLESYENIYWSDKAINTISGKYFSSWEILKEKLKDAKVFKNEKGEIKIPQAIMLSDLFTVLNMAIGVNEENEKWRGKGVFFKQSLFERGNEEKAEIIQKASCPSEALLRMICVDMKNLAEKFVNDSEKILHISEVDYQKDENKFVIKNWLDSALYCSQILKYFRVKARFQIDGNFQNYLDDLKIGEVIENYDVIRNYLTKKPQNELNKLKLNFENGNLLSGWSDGQEKSKGSVILRKDGILYLGILNKRNIFDTSKKDNIVYQNHTENCGRLLLKNLAMKTLSGKGFVSDYKIKYSILSKENPRQAIKNLQELIVKRGYAKKYSKLQDVSEKKYLDIKAFNNDLKNALLESYDCKFKEIDWSKIDQFIENGDLYLFEITNRKRNIQNLYWQEIFKKNSVIQLAGQGEIFYRPALLEKDREKLKTKDKNGKEIYKNFRFTKEKFLFHCSTKFNYQSKNYSKPIYAISEINKNINTELVKNEKQICFIGIDRGEKHLAYYSVVDKNGEILEQGSFNKIKDETSGKETDYAEKLEKMAGNRDESRKNWTTIGTIKEMKEGYISQVVRKIVDLTIKHNAYVVLENLNSGFKNSRKKIEKQIYQKLELALAKKLNFVVDKKAKEGEIMSVQKALQLTPPVNNFGDIEKASQYGIMLYTRANYTSQTDPITGWRKTIYLQKGSEEKIKEQILNAFDDFGFDGKDYYFDYTTKYKEGNKIIEGKKWRLYSGKDGKSLDRFRNESVYENSEKIWKTIPKDVVEILDKLFEGFDKDSGESLFQQIKNGKQLNKIDEYPAWESFRFAIDLIQQIRNSGSKDKDGNPTKDDDFILSPVRDENNSHFDSREGGAIISNGDANGAYNIARKGMMMFERIKEFEKMSETEKKKKKYPDIFIRDKEWDKFAQK

SEQ ID NO: 103 - protein, 1367 aa, unidentified
MKKLKTKGKYFSDFTNLYELSKTLCFELKPVKSTQAMLEENKVFEKDKTRKEKYEKVKPYFDRLHREFVKESLQDAHLENLHAYFDIYKKWQKDKKDTKLTKELDNSEKNLREQIMIFFNEKAKEYANKHSYLKKRDIGLFFEEEVFQLLKERYGDEPEANITDEATGEKVSIFDEWKNFTGYFLKFHETRKNFYKTDGTSTAIATRAIDQNLKRFCDNWLIFEKIKNKIDTSEVEKNFNVYLENDLSPKSYSNYLLQNGIDKYNEILGGKTEKDGNKLRGVNELINEYRQNNKGEKLPYLKPLDKQILGEKEALISENEIDENNILDKLKDFKNNAEKRISALNKSISDFVENENYELDKIYISKEAFNTIAHKWTNETQKLEEFLYGAMKTDKPAGLKHDTKENTYKFPDFIALQYIKSALENIMDEEKLKFWKERYYENKDEASGNGFLTDEENIWDQFVQILKFEFSSILKRTVTKNFSDKDEYEKFKKYAQNFEEIDFENKEKMQIKYYSGFVVYRKKLDQFIKDFELDQNGKIIIKNFADATLRAYQMGKYFALEKKREWVGDNFNPGDFYTNPSFGYKEFFYDNAYDEIVKTYNELRNFLTKKPWEDVQKWKLNFESPSLCAGWDKDLESQRRAIIFKESDQYYLGIFEKKHNHLFEDYEKIKPSGDEKIIQKMYFKQQTNVFRQLPRFGFPYKLKTSKDKGLIIDGFKNFDDKKFQERKQKYGLTEELLLIKDEFDLFQNSKSKGDLFDSQKLNKLIQYYKRIIEVDYKDIFQVEHILKKEYFELNKLYQDFEKSAYELDFKSVSKKYIYDLVEQKKLYLFEIYNKDFSSFSSGNKNLHTLYFQSLFSSSNTTEDKYFQLGADAEIFFRPKAIEAKKVKRNFKREIIEKKRYSADKIFFHCPIKLNAGADSVGKGYSYKFNNKINQFLANNPDINIIGVDRGEKHLAYYSVINQKQEILDSGSLNFVGKGTDGKPVDYYEKLEQKAKSREEERKTWSTVESIKDLKKGYISQVVRKLADLAIRHNAIIVFEDLNMRFKQIRGGIEKSIYQQLEKALIEKLNFLVNKGEKNPKEAGHLLKAYQLAAPFTTFKEMGKQTGIIFYTQASYTSRIDPVTGWRPNLYLKYKNAKQAQEDILKFDKIEFNQAKNRFEFSYDLSKFAKDKKKVKLPKKTKWTVCSNVDRFYWNRNLVNNKGDYEFFPKEGEDSLTQRLKKLFDNFEVNYQEGQNIADEIEKIDADKKNNAKFFKDLFFYFRLICQIRNTQKEKEGDENDFIFSPVEPFFDSRKSEKFGDNLPKNGDDNGAYNIARKGIILLNKKIGQWYKNNNFLRRQGKKEEPYPNLFIWAEEWDNFSQSKFDKN

SEQ ID NO: 104 - protein, 1359 aa, unidentified
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNQNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFENPNLAGGWSDGQEKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYFFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 105 - protein, 1369 aa, unidentified
MFFNFLTFGIMENNNFKDFTNLYEIIKTLRFELKPIEQTKAITEKLGIEEKDELRDKDYDIIKPVFDQLHDKFIRESLFLFNENWSELAKSVNSYKKEIEGINKKIRQTEDDKELLKLQKRKEEEKNNYEKKLDEFRKKITDNYEKIAEKWKNLWKDEKGETILKENGYKILTEAGILKVLKKIFENETEIKNLVKENSKAIEMMENKFIFYLKKIENEKDFSWWASINTGENEKNFDKNQAKKYLEEILEKIYKKDLKEIQKQVLDVINNLNDFWTYFSAFNNNRENYYSSENKSTAVANRIVNENFITFIGNINNLEKIDISLSNQEDEIFKIENYNKYLSQEGIDEYNEIIGGKKDEKGVRIEDGINQRLNEYSQKNNKEKIQLKPLYKQIGSIKSKSIPFQMVETEEDFKSILEKLTNSSKKNIPIIIEKLKNIFENDEKELEKIWISKNNLNFISNRYFSNWYILAEKGVELKVFSKKSKKDLEDGENFSIPKYISLKDFKEMLEKVEFVDYSDIEENKRNYFFKKYFEEKRGKITSNWEFFKKIFREDVENLYSGKDEEIIFAESGNEETFTVKSFLTYLKELEEIIKDFNTKNQKHKKILKLFADKSIFIFQFLRIFKVNRDFIEAKSEFYNFYDEIIEDFLVTKYYDAIRNYLTKKDFSKEKIKLNFNCGYLLNGWDSDFSTYGTLIFKKNDNFYIGIINGTGLSKENVEDLRKGITDENKIEKMVLETQKVDNKNPPRWFIRSKKDTFSPMVREKLIDPKPILEIYDKGLFSKNKNKDSYKQYLPKIIDYFKEGFRKHKDFEGFRDNFLNWSDSNSYETIADFYNETADLCYKLSWEEINFDKIKKLNLEEKIFLYQISSRDFNSNGNKNTQTELFLNLMNEKNNKFLKLLGQGEIFFRKSSSFDKKIIETKKGIKIEKDFENPFHLKRYSSDKIFLYFPITIKGRNLKEGFNSFLNTKIGNPDFYKNIHIIGIDRGEKHLAFYSVINALTGEIVEQGSLNIINGVDYERLLSQRAYSRLKAKQDWESIGNIKNLKEGYISQVVKKISDLVLKYNGIVVMEKLNKGFKRGRQKIEKSIYQNLEVSLVKKLSYLTVKGVEDFENGSIIKAYQLCPLAKNYSDIEKSRQWGILFYANPAYTSVTDPITGWRKNIYLSKGKLEEMKKNILDIFFEIGFDEKEKAYFFKYKISGKEWILYSGRERWRGTVDKKTGKWKIYEIFTTDELDKLFEENEINKNKEIISQIKEKTDLKGKFFESLIWIIDVILQIRNKDDKENDMIISPVKPFFNSKTYFDQLSEDEKNEKFEHTNYLRLPTSGDANGAYNIARKGQIMLEKIQKNPKINQPKLLVNNEQWDEFIQKS

SEQ ID NO: 106 - protein, 1276 aa, unidentified
MGQHKSSVFDEFTRKYALSKTLRFRLEPTEKTKELLEKNGIVPKDKEVYEAYLKIKALLDDLHREFIRESLLDFDSKYFSDAYEEWKKWKQETDKNAKSKKSEQLRGRYGKGGRYSDLRFGIVARFNETAKKWAEETYSDIEFKKRNPDILSEKKIIELLKRKFSDPEQVETISKFDRFFGYLDGYNQSRKNLYSGGNENTALAYRMVDVNLERYFANIFAFEHFSEYPGFRLTDSEKKMMNPKSYPGVLLQEGIEGYNESVGAMNKRINEYRQSHPNCGATFLLTLHNQILGQRDRPLFLDAIESDDDLVGRLEKLYFEAESERLGNGGDTRIRTLENIVRRGLNDEVLQKSVYFSKVALNTLLHKYLTDDGRNALLGSGGLGNKRKKSDESEEEYALPKAVSIADFRRALENEKNEGISLWKDFVVSGAVRGGVVGKDEEISHKENYRIFSIVFLQQFIDAEKGFADVVSGKRIPGHRETSERISSFLKSGKLGEGEARETHVQIIKEYLDSLLRFHRMVRYFTSKDIDHLDRNQDFYSVLEDYSNEYSLGATYDAVRNYLTKKPWSEEKILMTFDEGNLLGGWQESPKGNAQFHAYIFRKSARYYLGITTDPRLFDANKYPESSASGSYEKMDYRQLKSQTLYGSVYLGEYGVKYKTDAERLDASTLIGKVKTLLRKYAITFPELELIIDKNYADPKQLAKDVSALTLYSISWDSVSDEFVERGVYSTKKKDKDVFLYLFEICSKDIGVEKKTKGDLQALYWKNLFSQENAEYESLKLSGGGAIFFRPASIEVKEEKRKTVNAKEYMVIAKKRYTEDAYLFHCPIILNALNDSISENFKELHHRRFNEKTNEILASNNDKPCVLGLDRGEKHLVYYSLIGPDGVLRESGSFNEIQENGKAEPTDYLSKLEKREAERKIAREEWKTIGTIKELKNGYVSQVVRKVADLALQNNAVIVLEDLNTGFKRGRQKIERQVYQKFELALAKKLNYLVDKSETDPEKPGHPVNGLQLTPLVSNYQDIEKKLQVGIMLYTRAGFTSTTCPVCGWRRKPGMWEAYANEEQARIYLGKVSIVRNDEGYEISHKGLHESRKNKRGSYEIDYAPEKLSTHRAVRYVWSRMNGKSVSNRIDVTERLDELFRGVGIDPRSGHDLSVETLSRKEGLVKSDFYRNLLATINLLTRMRYTETTADGDERDMIHCPACDFRSDEGFIGSDGKKHEWNGDANGAYNIARKGRMMLSRISDFEHRKKNGKLGKGEKYPNLFISDSDWDAEVIK

SEQ ID NO: 107 - protein, 1353 aa, unidentified
MANDIYAQFTRKYALSKTLRFELKPVGKTLDNMRKHLEYDPELRTFLKDQCIEDAYQALKPKVDELHQRFINLALGSARAKSMEFSPFFEIRRQLLELKMKAKEKGVGDKDIQNLEGELDGAGETLRKAFGDIFKDAGARWKELYGAYGWKKGGKETKGSAVLSCPDVLKVIDEENEKKELPEQCVRDAIKALEGFFTYLGGFNQNRENYYETAKEAATAIATRIVHENLPRFTDNALTFESGNKEYLDAYRFLKDAGKVIQRKDEKPVTPISEAIFCQNYFGNCLTQEEIERYNEEIGNCNLVINLYNQTEDEEGFRRLPIFKVLYKQIGCGKKDALFFRLTHEKKEDADAARRENPNKQFDSVEEILERARTAGEKYFQPNKTADMDTLSEFIRYLKERKDYSGFYWSKNALNTISNKYFANWHALKDRLKETGVFKKGGKDDEEYVKIPDAIELQPFFELLDVTKDWRKTLFKLSQRNGSEEIEKMRIIDNAKTPHEALLGMLTLDVADRAEKFVNGAAGVMRVTREYFANADKMKEERRRVWKEEIKQWMDHALAVNRMLKYFKVRESKVKGAPIDATLTKALGILLYGKDGDAEWFKWYDTLRNFLTKKPQDDAKENKLKLNFENGSLLGGWSDGQEKNKAAVLLRKDGLYYLGILKKKSLFDTKQENNPMYEHFTQGCERLILTNLKFQTLAGKGFSRKFRIAYGAMGKQDPQKAIISLQDIMKERYLNKYPLLSPIASASYTDKKKFDKEVQEALKESYDCKFRKINWNEIEQYTKSGDMYLFQIHSKDFAPGASGKKDLQTIYWQSLFDSNGSHQLNGGGEIFYRKQALRDKHVKKGYEQKPWIIESRRFTLESGKFMFHCPIKLNYKSSAQSDPKYAFPFVNKYINEHFAGNADICFLGIDRGEKHLAYYSLVDSRGTIVDQGTLNIPFTDSKGNPRTVRAIKRTLDKNGHEWVEEVECSNYNDLLAARAGDRDYARKNWQTIGTIKELKEGYISQVIHKIVRLAALDSDKPMFIVLEDLSIGFMRGRQKIEKSVYKQFEVALAKKLSFLVDKSKDGKYGEVGSVTAALQLTPPIKNFDELKERGKQAGVMLFVRPDYTSQTDPVTGWRKRIYIDSGSELTIRKKVTESFEDIAFDGKDYVFVYKDVVTGKCWSMYSGKDGESLKRFHRVRSVDKDEWKSEPQNLAEMLDCLFKDFDKDRSLLSQIVDEGMQPKKVNEHSAWESFRFVIKLIQQIRNTDGGDGGRESDFLLSPVREHGNHFDSRPYWDEEQRTGHPALLPSCGDANGAYNIARKGIILHEHMKRDFKLYVRDEEWDSWLAGKETWDNWLRNHEKDLRKTPRKGG

SEQ ID NO: 108 - protein, 1311 aa, unidentified
MLYSASFTNLFSLSKTLRFELKPVPETIELLKKKNIFGKTPVEIDQEKAELYNKELKPMFDQLHEMFITESLKIIQFDRAQLEQLEQQYQTLKALNKDKNTNSVAIDQLVNPKTGLIAQLETKLREVVTNSFLQTGEIWKQQYSDIKLKDNGYKILTEKNVLELLKKIFPEKIEYIKKFDGYFMYFNGYGQNRENYYTSELKSTAIASRIINENLRTFIENRQNYQIIKNVPGLDKYAELFELKNFQNCLTQTDIDKVNEDVIGEINKQVNLYCQHENSRTDRKENKLRYPMLKKLYKQIGCTVTCDDVDMSHVFPFLEKVGMGFNIRKDSTGKYQIWDALESLATQLQPKIDKIFANYSSFFTDPSHYQLDQIWFRKEALNTLSARWFGGENWASIERALLYSGVGKKEKEEYRIPPFVSLAEIKAAFDALEQGVNLNLNKKRAKENKESEENSVQLFTYEPSNLFKVSYQPHFKDRLFDTFISIWKYELEETKKVLNDKLSLFNKSKSVDFDKNIKDKQENSIHLTLVKDLIEDGYLRLYQLTQYHNLIKKGELVALPTDSVFYNCLEEYWLENPTITYHKAFQSTLTKKPYCEDKIKLNFECGTLLEGWSASYESSGALIFSQNDRYYLGLINGTKLNKEEVDSLYQDFSEENKGARLVYLTQKVDNKNPPRWFIRSKKTAFSPMVRQGLLDPTPILDIYDNRLFSKTENKDNYRQYLPKLIAYFKEGFLKHQDFKLFQSEFKWKNDNEYDSIAEFYEDTADMCYKIEWEKINFTSLINLVIKEKMYLFQIYNKDFELNQSVGMKKYGENFHMKSSQGLPNLHTMLLRMLLKPENIHSLKLLGGGELFFRAKSKVKEVKLDKSGREVLSAPRYYEDKYFLHFPIEIKGRKLKYGLNQYLNNFIIDSQHSPLVIGIDRGEKNLLYYSIIDIDGNILKQGSLNTIKGTDYNDKLQTKQEARKQRRLDWEEIGNIKNFKEGYLSQAVHEIYQLMIEYQAVVVLEDLNAEFKAKRAAQVEKSVYKKFELALAKKLNHLILKDKKPEELGGVLNAYQLTPAISAGDVGKFERANQWGVMYYVRANYTSTTDPMSGWRKHLYISNSETETKIREFFNPLTGVQINYEKGSDAYSFSYEYKGRRWKLYAHSRLHRYCWNNRERKLEYYSIHSLLGQLFARFDKNKNINTQLLADANFSGQSWKDLVFYWNLLNQIRNTDPEKVGDAADFLQSPAIPFYDSRDYAGKDNPKLPTGADANGAYNIARKGVMILQRIRNCKDVAKFGAKQGNVDNENGYYIPDEAWDNYATKQAKKWQ

SEQ ID NO: 109 - protein, 1372 aa, unidentified
MKMSEQFCGQGNSVSESLKELTGLYGLSKTLRFELKPEPDTKQIFEKWIEELQNVSDVNEAIKNGNLFAKDKVIYKAYLVLKPILDSIHEQFITLALQSEKAKDIDFSNYFEKYRNKEKLDDEEKKLRIKIGELYSVPAKEFAVSKKGKTNLKESKPYEVLTDKLIFSLIEKNISSYTQTVSEEELKKYLEVFKGFFTYFSGYNINRENYYETKEEKSTAVASRIVHENLPVFCNNIIRYETNKEIYNNIYNELKKNGRETKLKTETGEKEAAPITEQFFNIDYFSKCLSQNQIDSYNDVIGNNNLLINLYNQLHSKDSGFKRIQLFETLYKQIGCGKRKSLFLQLLKDTETELTDEQKNSGEILSLEKLLSVIAERIKQVFNKSEKDVGISTIPDLLEYLENCKDWKGIYWNKASVTSISNKFFMNWHDIADKLSKNSACATFNKNREEQIKLNDAVELDGLFSVLDENKVETILKKSVLDEYNNVINPNDSASKNLMKILCSNTRKSLDYVLLNTEKVLAAKRMQKESDSEEDIFVSTIKNWLDSIIDVFHFVKNFEVRESKVKGNILNSEIKEAINLFLHSDDATWFKWYDIVRNYLTKKPQDDVKNSMLKLNFGSSSLLGGWSDGQEKVKIATLLKYDGSLFLCILKDKNIFDTSQENNSIYKKDGKGSRLILRNLGFKTLAGKGFLSEFGISYGDMGKENPEKAIKSLQEIIKTKYIKKYPALKTIANGDYSDKKKFDADISEVLKDCYICSFENIDWDLVQKKEKNGDLFLLKIWCKDFAEKSNGHKNLQTLYWENVLSENSKHQLCAGAEIFMRKPIDNKKPYVHEANSIIICKKGVPDFIYEKVKLIIQQNKSATEMELREIIKKNSKEILSTMNTDFDLSLLKFSKKEHEIIKDKRFYGENKYFFYCPIKLNYSSKIYKSPIFGYSEINTKVNEVIQKSDDITYLGIDRGEKHLIYTCVINKEGKIIDCRSQNKIEETDYNQKLSEVAESRQKARKNWQTIGNISNLKEGYISNVVHNVVSQAISKPTYIVLEDLNTEMKRGRQKIEKQVYQKFEVALAKKLNFVVEKTAKENELASVGKALQLTPPIANYQDIENKKQFGIMLYTRANYTSVTDPLTGWRKTVYLKKGSEEFVRKQILESFTDIGFDGKDYYFEYVEKHAGKTWRMYSGENGKSLPRFQNNKKLENDKAIWEPETVDLVSILDELFADFSKEKSLLEQLSNNEHQLHKVASRKETAWDSLRYVIDTIQHIRNTGKTEADSNFLYSPVRDENGIHFDSRNYHNNDLPADADANGAFNIARKGLIMDSHIKQWIKDGKKDKDLDLFVSDEEWDLWLLDKEKWHEKLSIFASRSAKEKQERKRSK

SEQ ID NO: 110 - protein, 1515 aa, unidentified
MPDKQKNSSGGAFDEFVGKYALSKTLRFELKPVPRTRQLLELDKNNIFPKDKYRAENYAIIKKYIDKLHAKFINAALALPEAYIDIKDSLKVTESEAEDESVDEEQSVESDDGEEKGAKSKDHKKVIDLFNQLSKADKIGDKPDEFNGWVKVEKNKVSGKLFNKELIDILRIEFSDELEADINVPVLFFNKDEKGKKRKLKEVFNSFGALGKGKDKEGQNFTTYFSSAFHDNRRNYYKADGKAGRVATRIADENLTRFCTNLEKFGVIQSKLPKLLNKFNQGWTEYFKEKGMAEEGWVKQFDESKWQDEVFGIKYRHFLQADINRYNFITRKLNKDINESGVQSDNFQKLHKQVHGEVKKQDEEFEVDKDNIFSPTDSFIKKFITHSRLKLEFSREIFFQFLNEKFLDPKNVFLSSRAITTISNKCFVSWHTFGGKILEYLNNGKPEKKQRKKLPDFVDLQTVKNVLDAGKDVLLLDMFKYRYFEVIDPNDEQRKNEREELEVLRQKLCEGEHWKNFLRIVKFEFESLVVIHNETAQKLLAETVYKKGNKDFSKSEQDKQVDILFDFAESANGILNMTKYFALRKKGVMVEKKEYANRDEIHEQVEAYLDGDNEQQERCLINGYYKALKHFITKKPWTEDKVVLNFNNAQFLQGWPQSQEKVKCGVILKKKQNDRDLYYLVVLEDKNYFENKDLYKDIKSSAWQKMVYTQLQNPSRMLPKIFITPFLVASGDNKAEEKWEGIDRGQSGAKDKIKIGIQPTDEILNGYIQGKHKKQKKINPDPKFLQKYFDFLKDAIRKYYDKEFSFPDTKGFLDTSLFYAWVEENVYDIQTVNISDNTINDLVVNPKNKKQVYLFQIYNKDFEIDEEIGRAKYGHGFLTKAEWRKQAERNEEEKEQGRENLETTFFKLLFDAKNLKNDDGVVYKLSGGAKMFYRPASESLEKKKVKDKDGQEKEVFDRQRYKEDKFLLRVPIVINFVNKREGYKINEDVNKLIAQTPFGHDKFRIIALDRGEKNLAYLSVLNEDGKILEMRSLNEIHRFGKDEKPIAEKNQYHDKDGNPVGEAKVEPFKDYHNLLDLREIERLKARKSWERIEKIADLKEGYLGFVVNKIANLVIKAIKEGKVPIVVLENLNVGMKQGRIMIDKQVYSKVEEKIAKKLSYLIDKKLGNFLEAWQLTPEIRTFGGDIESKSQVGIIFYVNPGYTSAICPACGFRKRKYIKTKKAQEEFKKINITFDGMKYKFEYSSEVKGINSGDGIIQDIVYSNVRRVVWDRQANNGKGGVDEIADVTEKITSLFEKFKIEKTTDINKQLQDLNFSIKEEETKFWVQLCKWFHCVQEVRNSVNKRRKFKEDDANGEIEEWGENRDFIFCSHCYFDSEDEREWNELKEKIYIGHDSEQVKFNGDANGAYNIGRKGIMEIEKVIKYYSELDKFKKYWSILRLPKKDEKIPFVKDGNEYVLTMLNDKKKQPYYCVLKFKKESIEAISAERKMRRYPDLLISDSDWDEWLAKNSPAHSQ

SEQ ID NO: 111 - protein, 1139 aa, unidentified
MNEFLGLEEKTINICRELKPIGKTRSNIDKFKAMEDDDFIYKNKYVINDLLKKVAMEKVEKALKSISKELDFSEMFALMETLDEMQGEERREVFQNLFAERIALLNELSTVLDFKFTNKKTIEVMLPEYVENHNFKNKDELMKMVEIIKPRQAKFERFEKNIDSLINMNLKKGSLSYRILVENPQIHLENVRLLTRFDYAGILREEPDEVISFCKNSSLDDYNSLLFQKNIDVYNYCVGVINQKLNEYCQQEKLSYSELELKTLRKLPLSERKSFFDKIPFFESDKELVESYNKLVTELNKHSFNSDVLSNDLNIYIKSNQINKYSNIVYGKWGIINDCLEEYCNEYGEKKEKLLNNISIYDINNIVEEFSEKLEIPYNNNSLQQIVEFSFANTKYAKCDIPMISLRNDECKEKYEIKKNLDKAIEFIRLLRLFDTENENFSFDAKQEVEKTLDVYNDVNLLYNMAKNYITQKGNNKIKNALSFSTSGFAGGWSESIESNKRVFLMKNDLGNKYLGIYNLLGCKANNESVSSVSRIIKESLTEEKTEKQCYRKMVCSVTSDVKKSIPRLFVNSQLPEPELTRFKKKEYNDDEKFLTFIIDFIKEKIEKHETWKLYDFKYKKHYESYDEFCEDLQKQGYILKWKYIEKSIIDKLVDSGCIYLFKISGKYDKYNFKKSIHEKYIDALFSDENENGKLIRLLGNAEVFYREPQIKNPYIHKKGSILVNKHYDNGKTIGSEYSEIAKNIQGTTVDGIVAKVCHREIIKDERYTKEQFSIHIPVKIGNISSKEKVDSLAIEKLKKPHNTIVITRSNNHFLYAVVFDDKMNVLEKRSLNVVKGVNYKEKLEIAEDLKKKDASSWKEIKSTSGLLDGYVSYAIREVADIVLKYDAMVVLEKATNGGSFNLLSTRTYVKFKNALINKLQFLNDVSKKDTEPGGVLNPYNLTHVDKDKDFEKELNGIVLQIPAFYMAMKDIKSEFVLLKSPFAKNQSQRKNLVNKFKKFNFNSKKNVFELEYDSKKFNSKYKNTFICDSFGERIIRQNGEIERVNLTDYIKQNLWENGLDFRTGENLYSIYDEQNKSHINALYESIKLILQMYNFDSNEAYYVSPVSHTIITDSDCREIVQSINLYKKAVELAKQYYT

SEQ ID NO: 112 - protein, 1466 aa, unidentified
MSENLFSHFTQQYSLIKTLRFSLIPILTEKQEKDIFYQKGYKNRDQIQRQDKIEKFFNENKQDVFEVDIERKKRYRALKYYLTELHKLFIKDALGKAKVNDSLNFSSLFEKYKDFEKEKDDNKKSQLAKGINEEKARLVKFFGNKDGKGGLFQKTAEDYYDWLKDNLNENEKIQDNKDEKQKKNNILLSQNVLLILAKKIKNDNIKEKVKNDKDGNNLYALNNIEYLKKEELRKGTLTEYFQGWSTYFKNFNEIRGNLYKDDGRKVDEGDIENDIKIRKANAGQITTRILDENFEIFVMNSIWAETNKKNLKTEDFQNKDIEDGISIFTPEFYVHCLLQTDINTYNAKIVELNKFFNENKKPNSDIKYLKTLQKQLLLTDKPDGEEDYFVYEILDDDELIKGLEEFSTLSREKIKGIKTFLQGKIEYNLEDIQLNENQLHYFCNKYFGSWSYIRDLYYQQNNIVDEDQAKKDSEFKDKEGISKVAISLLEIKELLNKETVENFIETIKNGWFCRDYKYPSKTNIDLLKNAGVYKEESGNFENFLSFLKFELDSLLNGRAFLTKREQEDKEKIKATKQSLKNSQKERERVDELLLNKFSEENFTQDIADSFEKKQEKFESAFTDLKKAIENKQKLQRAKDFECKKAINEYCTRISDINRYFALFSVPEGVTSGFLNTVVTEFKEDNQIVPLFNAIRNYITKRPEETEKVKLNFDYNNLLDGWVYKNSDHPASSDYHCRLFRKNDSIFLGIVGDAENNLIDSSYELMDYYQIKGQTIFGSTYAGLFNENKYTQDRQEKSNKELLNNIDKIIDEKLIAAFPKAETYIKKIKKDRTSGLFDFEITREQIDRLFTGKTGTTYDEYRKADKKKVVLEILRKNFRNIFNFNEEADYLVNKIGELFGKTPKRKDFKGVDKMVYELTKLEPFFYKISFNAVKQNSNDTKIKALFQIYSKDFSPDKNPNSKKNLHTLYFEELFSKENEENPIFKLSGGAEVFFREKIDDYKVDQWEKKRLKNPKTDKLPNKKRRFTGNQILFHLPIVLNNINDGGSVNRKVHEYIQENEDVKIIGIDRGEKELAYYCLLDQFGTIIDEPKTLNTMGSNVIDGVRQPINYRNKLDIRERERMIARRSWTKIEGIKDLKQGYISNVVNEIAKLMVDNDAFICLEELNHGFKKDRSIRIEKGVYQRLENALVDKLNYLVLEKTPEGVRNARQLTEKNRAIKSWGNQMGALFYTDAKFTSKTCPNCGFRKRGVSDFNNRENLREKIKNGDLKVFFEKKKDRFRIEYNWNYEYRMNNKTELYSNRDLYDQENNMEYIYSDVIRSDWYRKYDPTIKLKEIFKAFYQTSKENIAIKENHFSYSVFIEVFNIILNIRNRTNEEDIISCPKCHFSTLPPKVQKINNGDANGAYNIARKGLMIFEKIRSEKLRKKIYTKKGIESKDLKITLQEWDELTYSQWNKKDWNESNNERGL

SEQ ID NO: 113 - protein, 1547 aa, unidentified
MFDQFTGKYQLSKTLRFELKPMPRTKRLLGLDNEDIFPKDKERAENYAIIKIYIDKLHSKFINAALALQDAYIDIADFAKEQKSMEGGEEIIDEQFVENNGNEEKRAKSKHHQKIIDLFNQLSKAEKIGGVENRFKGWVNISKNKVSGKLFEKELIDVLKTEFKDEMDTEVPVPVLFFNKDEKGKTRKLKEVFNSFGKDKDGNGQDFTTYFSSAFHDNRRNYYKADGKAGRVATRVVDENLKRFITNLEKFNTIKAEHPELFNERWKEYFVEKGLENENWVKNFEETKWQEDIFGFKYRHFLQSDIDRYNYITRKLNKDINESGSGTKNFQKLHKQVHGEIKKQDEEFKVDKNNIFSSNSSFIKKFIEHSRAKLVFSQKIFSKFFNEEFSDPKNVFLSSRAITTISNKCFASWHTFGGGILDYLNSELPEKKRRKKLPDFVTLQIIKDVLDTAKDTPFQDLFKNKYFEKIDSKDEQRKYEREALEKLRQKLKEGEHWKNFLWIVQFEYKSLVKLHNDTAQKLLAETVYKKGNKDFSKEEQDKQVGILFDFAESANGILNMTKYFALRKRGVMVEDKKYKDRDNIHEQVESYLDGDNEGQERCLINGYYKALKDFVTKKPWIEDKVVLNFDKSQFLGGWAQSQETVKGGVILRKKQDGNDLYYLAALEDRDKTFFKNKDLYENVGESVWQKMVYIQLQEPHRMLPKNLIAPFFVKESKKYQDMNNEKKCEWFNELESKGVKFFLNNDGHNWTKILKEELVRRIKRGIKDKKSIIWAGIDRKKNGAKKLIKQDIKPSDKFLENYLKGKHTKENLDRGYLQEYFGYLKESIKKYYKRDNLSFPDTAEFSDTSPFYTWVKENVYNIKFVDINEQVITDLVINHGNRKQVYLFQIYNKDFELDEEIGKAEYGDKFLTKKEWRKQKERKEEEKEQGRENLETTFFKSLFDSRNLDSDKGVVYKLSGGAKMFYRPASEQLGKKKIKGRDGREKEVVDRQRYKEDKFFLHVPIVMNFVNKNKGYKINDDVNKLIAQTSSGQDKFRVIALDRGEKHLAYLAVLNENGKVLEMQSLNRIQRFDKKNNPIPEKNQYHDKDGKPIGEPQVEPFKDYHNLLDQREIERLKARKSWKPIEKIADLKEGYLGFVVNKIADLVIQAIEKGKVPIVVLENLNAGMKQGRIMIEKQVYSKVEEKIAKKLNYLVDKKLGNFFEAWQLTPEIKTFGGDIEGKSQVGIILYVNPGYTSATCPACGFRRRKYIKTDSAKTEFANIDISFDGAKYKFKDPPNFKDSDVRPIGAAVYSNVRRAIWDRYANNGRGGVQEVADVTKEFSKLFREFGINYRTGNINKQIQNLSFPDKEERKFWTRLCKWFHCVLEIRNSVSKKRAVKEDSANGEVEEWGENRDFIVCPHCYFDSEDGRKWSELEEKIYIGSHPQDLNFNGDANGAYNIGRKGIIAIAKIRGHRENFDRFIKAWNIQCLPKKDEEIPFTKGGKKFTLTTLKDDKKQPYYCFLKTKKESFESIPVERNMRKYPDLFISDNEWDEMTAKWAKENGRK

SEQ ID NO: 114 - protein, 1061 aa, unidentified
MNKADSVFSNFTNQYSLSKTLKFELKPHPLTKSLVEVVNKDKEIDRLSTKEMKPMLDALHEKFITESLEKMIFSISDLEQLERHLDDLKVLRQKLKNLNNNKDKKKKEIDSIQKEIKNLEDKKSGKIPKLQQKLRQVIVDQINEIGDEWKEIYTKEGIKFEKDNGNKKKQGYEMLTTKGVLGILKSEYSQYPEKIKAISEFDQFFTYFKGLNDNRANYYTDEQKATGVANRIINVNLNIFLKNKNDFSLFLEKLPQLKDYETSFALSNFQKCLAQADIEAYNEKVGEVKKLVNLEYNQKVADKKDLLKGLNKLQKQIGCKIKQEREQLERGESIYPKYLEKVGLGFHITKTSDDKYQIWESLDYLNDQLIPQVKKLKDNYESFFENWQDYKLNEIWFRRESLNTISGRWFGGNNWFVLTKALAYFGTGKMNKGEYKPDQFISLLELKEAMEALENGVDFDIKKPNKKTKEGQTEAIKDEITKQYFYKPENLFRDKYKDIYKNKTLFVAFLTIWRYELKHRFKEIEFYLDDFNIQKKTPFDKGNKEHVKTVFNLMQEGYLPILQMTKYHSLEKKSEIVPGYNTENKFYETLNDFWEDNPINQYRSAFEATLTQKPYSEDKIKLNFDCGSLLGGWSPTYEAYGSLIFKKDNRFYLVLIKGTGLSDEEMKGLYQSIDRKNSIERLIYNAQKLDFKNCPRWFINSIGDSKAPAVKKYNLPVESIWEDYQIYRKLDKNGKDKYLEDNKNFRFRLIDYYKHCLPFHESLKEFKGNFSWKDTKDYNNLNEFYTDAVNSCYKISWENINFDALKRLVRNERIYLFQIYNKDFEIDTEIGEKKYGESYNTKEKLRKAQGNPKGVVNLHTQLFFELLKPENIKYLKLMGGGEIFFREPSKEKSYRFDTGRREVLKAKRYYEEKYFLHFPVEIKKTKESSESFNQKIYKTLTQNHKPCKIIGIDRGEKHLLYYSVISINESGGTKIEDQGSLNRVKTKSPVDEKKLECEYDEKGKLQKVDLVSTGKKVNYVDYHLLLDYYEKKRNLARKSWEVIGKIKDLKEGYLSQVIYKI

SEQ ID NO: 115 - protein, 1505 aa, unidentified
MPQEKSIFDKFTNLYEVLKTLRFELKPVGKTLHNMQNDFEYDENIQTFLKDQRIEDAYQTLKPMVDKFHEEFITDSLQSETAKRINFVEYVGVRREIIGHQKNLKKIQKQKRDEGKDDDIAKELKKKIDSASKLIETLEKKYRTDIGEAFTKTGNYWKEKKYKNYDWKIRSKVAQGEKILSSQDVLNLIGDTEKDEKIQNALKEFQGFFTYISGFNQNRKNYYEIKKEASTAVATRVVHENLPKFSDNTVIFEARKGEYLGAYNTLKKLGRELVNRDKEPLLPITEDIFKESYFTNCLTQDEIEQYNKRIGNANFLINLYNQAKRGENNFNKLTLFKTFYKQIGCGKKKPLFFTLTHERKTEAESAREKNPAKKVFSVEEMLAVTKSAGETYLKNNSKNGQIETVPDFLKYINVRENFEGVYWSKMALNTVSNLYFADWSTLKEKLKAAKIFVKPDKRSEGDVKIPPVIELEALFSVLDKVEDEVWRNEGVFFKNSITEKVKDESKNQKNQKRQAIISQAKSPSRALLNLILDDIQEYSQDFVNNATDVEKITQVYFSAQGKEQGEKRQRWVETIKAWIDNACNANAMLKYFLVKENKIKGNPLDSEIANGLKNILFESKVKIDAPSGGEETVNWFKWRDALRNFLTKKPQDDAKENKLKLNFENPSLASGWDVNKEKDSYCVIFQNNEKRLFLAVSSSKYKNAFELKLTEGRGKNKTEKNNPLFKVGDGEICLKMEYNFWADVSKMIPKCSTQLTAVEKHFRRDDTDFIFPIGYKVTSGEKFTQECRITKEIFDLNNKIYKKSDITGSEMRYSLTDSQEKHYVKAFQKEFWELLLKKKNLGKEFSNKELLIEWKKFCKKSPSELSEWEIKYKAPLTAWINFCKYFLARYPKTSLFEYTFKNSEEYNSLDEFYRDVDICSYKLKLEKKTNRLVLDQLVDKGQIYLFEIRNQDSNDGKWKNHKNNIHTFYWETVFKDILNRPKLSGRAKIFYRKALPTKDLKKKKVKSKDGKEKEVIENYRFSKEKFILHVPIVLNFCLNENKINDVVNDHFPENNELYFLGIDRGEKHLAYYSLVDKNGKLIKQKTLNLAFIDKDGKPRAVEAEKRTIGEGGKEKVDVVECWDYNQLLEARAGDRDYARKNWQTIGSIKNLKEGYISQVVRTIADLATKDGKPTYIVLENLNTGFKRSRQKIEKSVYQKFELALAKKLNFLIDKQTKIGKLGSVTKALQLTPPVNTYGDIEKKNQAGIMLYTRPNYTSQTDPATGWRKSIYLKKGSEEYIKDQILGNKTKKINPAFSEIAFDGKDYCFSYQDKNTDKTWKLYCGNNGVGLTRFRNERNLKGKWVAELQDVVAILNGVFEKLNTNKSLLEQMKAGVELTKLQDEKYAKYTAWESLRYAIDLIQQIRNRGTTERDSDFILSPVRDENGNHFDSREYWDREQAGQECNMPTSGDANGAFNIARKGVVMNEHIKRGFDLYITDEEWDVWLSGEKAWSQWIKENLNKRKK

SEQ ID NO: 116 - protein, 1278 aa, unidentified
MRILKGNKMKRTKKERLTKVLSFELKPIGKTRQTITDKKLLKTDQEINERLDTVKPLIDLFYKHYIREALFLMGQPGSDYYIDFTKLEADYRFTSDKELSAEKHRVVVKNYQKDITEIQKIFHAAFLSVCPVKEKDLISAKLFEGIKKYVDTHLVGDPNYMEYQEIMENVTGCAVLLKKFMNTRLTALNTVGKRIMENFECYCNNIANIQLFMKSQVFSELEKNFPDLSSFQYADYYAKILTQEGIDYYNLMISGIFYPDGTRVKGFNMCVNEENIKNRNDHTYTGSFFRTLKKLDKQILYPAEKVFSIEHLDSDEEVRILFRELNGKVPTKKLLDIILLLKETTGDGIFVIGNDVHTLSHLCIKDHNTYPELLEKNYIVQRTNELETVSKQSERKKIEKNIINARSIVGSGNIQYSLEELSVICKSDVKSLYIHELELLYKRVLSKKELFDKSGLIKFGDFHSKVNKKIIKDYLESINDFRHVVQLIARGAESEQADILFYEDLNKQLECFTTAKKALNLVRNYVTRKPADTAKGATTETFFGSAQKTIAKWWNGVDKIDVGKNLILQKDNRYFFATLLPGNSISADSLLTGKSNYSVLTVKKGSNGMKNELPKRMFGQSNGKISVKKMFEADIDYCEWSGTKQDMKYPVKISRELYEANEKGLKTQDAVKKHLCTEEERRYWEVETIRLAQQILPLTVSYANVNWNFKAPEDYSSWLEFCAYCDTKAAYYSWLDVDENQINSLVEDGAMLLFQISHRDLYKNKKNPDSYVKTLEYLLSEENFKNPVIHLNGAPSFQYRKAVYERKITHKKGSILVNRWDKNGEQILNDIYMEIYNYYQGYVSKEELSKEALEELPFVRTKTAWMNFIKSAKYTKEKFLIRIIYTKNADVLNYGYNMINEETKEEIQEAGKAVLSISRSIYDLLYCVLFDKNGKVIEKRSLNIINGIDYYSLLKKIDKYRKSEKSNNWEYTTRIKDIRTHYIDLAIGEIVKYVTTYDAVIVLEKVNNSFKNKMQMIDNQLFKTFESRLELRLNDCYNKNISDGEAGSLTNPYQLTKQGNLSSVQNGYVFYLNGAYTNMCPVSGFVNFFNFGNINALKTKKELLLAMKKISYINNSFQFEFNYNSMERFLKDSWKNTTKEVKKTGYVLKTDWLITAVGPVTRYDREKKKNGYVADRTQKAYDLLKEHNCINDNGNVLVDTLNNTSLNAVYDLFAETVTNTTVRKCDVVPEEYYVSPVAGACPDISPSEIMAENLGRKFFYFMMHDTTEGYIGYMQEQH

SEQ ID NO: 117 - protein, 1413 aa, unidentified
KSRNYKIIFYKNMTTETKKFESFEDFTNLYEISKTIQFNLVPLKWDSERKNIAEDKEFAEFKKHGIIEKDEQTSKNIKTTKFYLDILHGEFIEEALKELRFKKEDLEKIYFLSQKLEENKRDKQVNKEEGKKKYGEFKKQLSIARDNLLEELKNIFILTNQRYKLKNKYPSTNENDKNILLSKHVLELLRKRFTKEEIDKLRKNNQDSSIVYPDVEDGKGKSVFNMNAGFLDDFHKNREHSLYSVKGKKGSFGGRILDNFEIFNQNKKIFEEKYKKSDIDFSEVEKSFGRNLNDVFGFDFYNGCISQNGIDCYNKILGGESHKEERKKTRGLNEIINLYAQKKEQDYKEQKKEGNQQKAKFSRKNYPTLMPLQKRVLSKILKKEILIEGDTDLICELNDFIKKSEGKVEKARTMIDLLCSYKKNHFDLTKIYLPKSKINSFAYKVFKEPQEFMAVYRDGRKNLGLIDFGKIKDYLNGNKLEYKDFFKPLAQGESGFDAFLCIWKHEFGILISGGETIVKGGQKEKVINLDIKKSELEKWLKWFKDKVAKNEKMTDKDEGMWCSAVLDYSQTILDITKRAEIFWLNEKQEIKVSDSKDGVFYSWFNEFIDDGFTPFIYFDKFRNYLNKRSKNTAKGFRLYFNTDHLLDGWDMNKEPQYRGFLLRKGNDYYLGIGNENGKIFHKLKSGSNLVEEVPEAYTVKDGDDYYEKIDYKQLDIGKFEGIAFPKKTNSEENYQKALKKRADEFLNGNISKLQKLIETKKEYDDFKVKRQKDKAWDRRFDTKKMKELISYYITCLNTRKEWKRFNFEFKKPEEYNDKPDFVNHLQRQAYWINPKRVSKKYVDEKVAQGEMFLFKIHSKDFYDFEKKLSNNNPYRLDKKPSKTNLFTQYFLELFSDENIRNIKSKDLNKSIFELDGKAELRFRRKTDNVKLKFYKKNGKIITCANKKDGNMEKEVIEHRRFTKDVITLHLKIRLNFGKEIEPQEFNKIVNTKLSVKESIEILGIDRGENNLVYYCLLNEEGEIKECASLNKVGERIRKLGDGTCIKEPVDYYQKLVEREQQRDWEQKNWQKITPIKDLKRGYLANVINEITKIVFANIEKGVATIIALEDLGQNFKRTRFFRERQVYQEFEKDLISKLNYLVDKNKKNYRKAYQFTFKVDSVQDMEKKKQIGNLFYVGASYTSKICPSPTCGWRKRLYIKNSETKGKIVKALESIKIFYEKEKDRFRFDYQWEQKYKKEGKEKKYGDIDTVFSSVSRLRYDRGKNKTEPYKDKTENSVTNKIKDLFKNRINIIQDANITEKIIKKEKELDAGFFHDLINYFNLILQIRNYDKENGDDYIQCPYCGFDSRNSKVDSEQLREIANGDANGAYNIARKGLMLLKRIKANPEKPNLIISSKDWDEVVSEWDKFVQKD

SEQ ID NO: 118 - protein, 1414 aa, unidentified
IKSRNYKIIFYKNMTTETKKFESFEDFTNLYEISKTIQFNLVPLKWDSERKNIAEDKEFAEFKKHGIIEKDEQTSKNIKTTKFYLDILHGEFIEEALKELRFKKEDLEKIYFLSQKLEENKRDKQVNKEEGKKKYGEFKKQLSIARDNLLEELKNIFILTNQRYKLKNKYPSTNENDKNILLSKHVLELLRKRFTKEEIDKLRKNNQDSSIVYPDVEDGKGKSVFNMNAGFLDDFHKNREHSLYSVKGKKGSFGGRILDNFEIFNQNKKIFEEKYKKSDIDFSEVEKSFGRNLNDVFGFDFYNGCISQNGIDCYNKILGGESHKEERKKTRGLNEIINLYAQKKEQDYKEQKKEGNQQKAKFSRKNYPTLMPLQKRVLSKILKKEILIEGDTDLICELNDFIKKSEGKVEKARTMIDLLCSYKKNHFDLTKIYLPKSKINSFAYKVFKEPQEFMAVYRDGRKNLGLIDFGKIKDYLNGNKLEYKDFFKPLAQGESGFDAFLCIWKHEFGILISGGETIVKGGQKEKVINLDIKKSELEKWLKWFKDKVAKNEKMTDKDEGMWCSAVLDYSQTILDITKRAEIFWLNEKQEIKVSDSKDGVFYSWFNEFIDDGFTPFIYFDKFRNYLNKRSKNTAKGFRLYFNTDHLLDGWDMNKEPQYRGFLLRKGNDYYLGIGNENGKIFHKLKSGSNLVEEVPEAYTVKDGDDYYEKIDYKQLDIGKFEGIAFPKKTNSEENYQKALKKRADEFLNGNISKLQKLIETKKEYDDFKVKRQKDKAWDRRFDTKKMKELISYYITCLNTRKEWKRFNFEFKKPEEYNDKPDFVNHLQRQAYWINPKRVSKKYVDEKVAQGEMFLFKIHSKDFYDFEKKLSNNNPYRLDKKPSKTNLFTQYFLELFSDENIRNIKSKDLNKSIFELDGKAELRFRRKTDNVKLKFYKKNGKIITCANKKDGNMEKEVIEHRRFTKDVITLHLKIRLNFGKEIEPQEFNKIVNTKLSVKESIEILGIDRGENNLVYYCLLNEEGEIKECASLNKVGERIRKLGDGTCIKEPVDYYQKLVEREQQRDWEQKNWQKITPIKDLKRGYLANVINEITKIVFANIEKGVATIIALEDLGQNFKRTRFFRERQVYQEFEKDLISKLNYLVDKNKKNYRKAYQFTFKVDSVQDMEKKKQIGNLFYVGASYTSKICPSPTCGWRKRLYIKNSETKGKIVKALESIKIFYEKEKDRFRFDYQWEQKYKKEGKEKKYGDIDTVFSSVSRLRYDRGKNKTEPYKDKTENSVTNKIKDLFKNRINIIQDANITEKIIKKEKELDAGFFHDLINYFNLILQIRNYDKENGDDYIQCPYCGFDSRNSKVDSEQLREIANGDANGAYNIARKGLMLLKRIKANPEKPNLIISSKDWDEVVSEWDKFVQKD

SEQ ID NO: 119 - protein, 1409 aa, unidentified
IKSRNYKIIFYKNMTTETKKFESFEDFTNLYEISKTIQFNLVPLKWDSERKNIAEDKEFAEFKKHGIIEKDEQTSKNIKTTKFYLDILHGEFIEEALKELRFKKEDLEKIYFLSQKLEENKRDKQVNKEEGKKKYGEFKKQLSIARDNLLEELKNIFILTNQRYKLKNKYPSTNENDKNILLSKHVLELLRKRFTKEEIDKLRKNNQDSSIVYPDVEDGKGKSVFNMNAGFLDDFHKNREHSLYSVKGKKGSFGGRILDNFEIFNQNKKIFEEKYKKSDIDFSEVEKSFGRNLNDVFGFDFYNGCISQNGIDCYNKILGGESHKEERKKTRGLNEIINLYAQKKEQDYKEQKKEGNQQKAKFSRKNYPTLMPLQKRVLSKILKKEILIEGDTDLICELNDFIKKSEGKVEKARTMIDLLCSYKKNHFDLTKIYLPKSKINSFAYKVFKEPQEFMAVYRDGRKNLGLIDFGKIKDYLNGNKLEYKDFFKPLAQGESGFDAFLCIWKHEFGILISGGETIVKGGQKEKVINLDIKKSELEKWLKWFKDKVAKNEKMTDKDEGMWCSAVLDYSQTILDITKRAEIFWLNEKQEIKVSDSKDGVFYSWFNEFIDDGFTPFIYFDKFRNYLNKRSKNTAKGFRLYFNTDHLLDGWDMNKEPQYRGFLLRKGNDYYLGIGNENGKIFHKLKSGSNLVEEVPEAYTVKDGDDYYEKIDYKQLDIGKFEGIAFPKKTNSEENYQKALKKRADEFLNGNISKLQKLIETKKEYDDFKVKRQKDKAWDRRFDTKKMKELISYYITCLNTRKEWKRFNFEFKKPEEYNDKPDFVNHLQRQAYWINPKRVSKKYVDEKVAQGEMFLFKIHSKDFYDFEKKLSNNNPYRLDKKPSKTNLFTQYFLELFSDENIRNIKSKDLNKSIFELDGKAELRFRRKTDNVKLKFYKKNGKIITCANKKDGNMEKEVIEHRRFTKDVITLHLKIRLNFGKEIEPQEFNKIVNTKLSVKESIEILGIDRGENNLVYYCLLNEEGEIKECASLNKVGERIRKLGDGTCIKEPVDYYQKLVEREQQRDWEQKNWQKITPIKDLKRGYLANVINEITKIVFANIEKGVATIIALEDLGQNFKRTRFFRERQVYQEFEKDLISKLNYLVDKNKKNYRKAYQFTFKVDSVQDMEKKKQIGNLFYVGASYTSKICPSPTCGWRKRLYIKNSETKGKIVKALESIKIFYEKEKDRFRFDYQWEQKYKKEGKEKKYGDIDTVFSSVSRLRYDRGKNKTEPYKDKTENSVTNKIKDLFKNRINIIQDANITEKIIKKEKELDAGFFHDLINYFNLILQIRNYDKENGDDYIQCPYCGFDSRNSKVDSEQLREIANGDANGAYNIARKGLMLLKRIKANPEKPNLIISSKDWDEVVSEWDK

SEQ ID NO: 120 - protein, 1273 aa, unidentified
MQDKTGWSSFTNKYSLSKTLRFELKPVGNTQKMLEDDGVFQKDRERQENYKKVKPFMDKLHREFIKEALNNLKLEGLTEYFEIFKKFRKDKNNKELKNAEKKLRQIIGRCYTETAQIWVEKYKEFGFKKKNIGFLFEEGVFELMKLKYGNDEASQIEKNGEVLSIFDGWKGFLGYFKKFFETRNNFYKDDGTSTAVSTRIINENLKIYLDNLIKYNKIKDKVDFKEADILQENKLNLSDFFNVESYAKYSLQKGIDYYNEILGGKTLKNGTKLKGLNEVINEYKQKNKSGELSKFKMLKKQILGEGEDRTLFEEIENEDELKDVLKDFFYNADPKITLFKTLLEDFFSNTEKYKDELDKIYFNTVAINGILHRWVDDSGVFQKYLFEVLKSNKLVKSNHYDKKEDSYKFPDFISFEHIKVALENCERDGLKDKFWKEKYYTKECLTENGLANLWQEFLEIYKCEFKKLYDYKTDDNDCYLQYRDNYKKYILDANFNPKEKSAKDIIKDYLDSVLSIYQLAKYFALEKKKVWTTDYETGDFYYEYIKFYEDTYEQIIKPYNLVRNYLTRKPINTAKKWKLNFDNAYLASGWDKDKEVSNLTVILRRDEQYYLAIMKKGKNKIFEKKFSCGEFEKMEYKQIAEASSDIHNLVLMNDGSCRRCIKMHDKRKYWPLDISIIKEKKSYAKENFVRRDFERFVNYMKKCSLLYWKEYDLKFSDTSTYKNINDFTNEIASQGYKLSFSAIPESYINEKNNNGELYLFQIYNKDFGIKTEGNKNLHTMYWESIFSEENRFRNFIVKLNGKAEIFYRPKSEQVEKEQRNFTREIIKNRRYTENKIYFHCPITLNRISRENVKKFNNGINNYIATNPNINILGVDRGEKHLVYYAIVDQDGKLIDAEDATGSFNTIGSTDYHRLLEEKAKDREKERKDWDLIRGIKDLKKGYISLVVRKIADLAIKYNAIIIFEDLNTRFKQIRGGMEKSVYQQLEKALINKLSFLVNKGEKDPEQAGHLLKAYQLAAPFQTFDKMGRQTGIIFYTQASYTSKIDPITGWRPNLYLKYRNIDDSKESIKKFKSILFNKEKNRFEFTYDLKDFVDFEEDKIPEKTEWTLCSSVERHKWNRHMNNNKGGYEVYKDLTENFYKLFDENNISMNKDIVDQVESISNGNFFRQFIYLFNLVCQIRNTDEKAEDVDKRDFILSPVEPFFDSRRAKDFKAYGDNLPKNGDENGAYNIARKGVLIIKKIKEYYNQNGSCDKLGWGDLSISHKEWDDFATNN

SEQ ID NO: 121 - protein, 1010 aa, unidentified
ILSESNRPNWIQSIDSNPAFLAAFKGFKEQFGTQWHPALKQSLSKIQTADPQTIWLRGDRLQPLSRTLFKDRFHLKNALEFSIRDTEGLTKQAHLKENPNLKKKSLEKWEQKALESLEQDDGAPQSIGRLDQLLNDYHRLNPSSLDPESPTDKAFTENPLQRHFSTSLGNRLDQSLEKLEKLWQSLRPLENRSEEDLPKNTGKDALPIKEIKDTLDDCLYLSRELAYLHLLKKGTPIEVPENNLDFYQSFDEAFSPYNDALQTLYNQTRNYLSKKPYSSEKLKINFEKATFLDGWDVNKENDHRGVILQRKGSYYLAILRKEKSITPDSLFVEPPSAKKHPDAYEKMYYKQVTGANKMLPKNFFGEKGRRQYQPPAAIIRIYENKEYVLGDNFKLESCHQLIDFYKKHLPTYKSKPTDRYGWEVFNFKFSPTSTYQNIDQFFQEFEQQSYRIWFRPIDPQTVVQAVQKGDLFLFQIYNKDFSPYSKGRPNLHTLYWRSLFLEENWQKPIVKLNGKAEVFFRPRSLEAKKQPTHPPGQALENKNPHNPKRQSTFAYPLIKDKRYTADKFFLHLPITLNPLQKTKGKGETKAFNLQVNQALVESPHSHIIGIDRGERNLLAYTVIDPSGTIVEQGDLNQIHTDQGYPVDYHQKLDKIQKQRDQARKSWETIDHIKELKAGYLSHVIHRLARMVVQYDAILCLENLQYGFKRGRFKVEKQVYHKFEKALIDKFNHLVFKEAPAGQPGHFLNALQLTLPCPTLQDIQRQNGILFYVRAAYTSKICPATGFVNFLDLRYQSLQQSIQFFEQIQDFRYCPKYQRFELDFDYCKIKPFTRGWHGGGQSEWRLGTHGTLRYRSQAHKKTQKRESIPVDSTAQLKQLLEEGGIPYKDTDLSKKIVQFGKNPASPRRSWFFKNLFYELKTAFSLRHSKVGSAEDFILSPVISEDGSYFDSRKNHPAYPANADQNGAYHIALKGLWYLRSFQKKPPTRPIETLKDVDWVPFAQEVAKTRRP

SEQ ID NO: 122 - protein, 1282 aa, unidentified
MKDLTRFSGKYKIQKTLRFELKPQGKTLEHIEAKGLITQDEERAQSYKKMKKTIDGFHKHFIEFALQGTRLSKLTEFTDLYQMSAEAKKSDLKFDDKFKKVQATLRKEISNAFKTGDANGIFKKLDKKELITELLEAWIESNGGVDEQGEKLYFDPEFKTFTTYFGGFHENRKNMYTDKEQSTAIAYRLVHENLPKFIDNCKTFEKIKAVPELYEKCVVLYNEIEEHLVNALSIDKVFELDYYNYVLTQQGIDTYNLIIGGYVTEKGDKVQGVNEYINLYNQQQKDRKNKLPKLKVLYKQILSDRESTSFLPESFEESDEVLDAIEQFYKGHILDYQPKDKEGTEHVLLNLKALLATIPDYDTSKIFIKNDNKLSTISQRLYGSYSVFRDALSHYYTSVLHPEFENTYEKATENKRKKLDKQRERFTRQKYISLDTLQLVVDTYISTLDEHHEVRTSYSENNLARYFKTHFNAEPKEGSDKIFDLIANTEAKYSCIKGILGQPYPAGKELHQDKNTINNIKAFLDSLMEVLHFVKPLVLPDDSTLGKDEQFYSQLIPYYRQLELLIPLYNQVRNYATQKPYSTEKVKLNFETSQLLGGWDANKERDYLTSILIKDGLYYLAVMDKKHNKVMLEAEEYKEGGYYEKMFYKLLPGVNKQLPRVLFAKSNIDYFAPSGELLTKYREGTHKKGDNFSLEDCHRLIDFFKKSLNKHSDWKHFNFSFSPTDTYKDISDFYREVAEQGYKITFKRIGEEYIHQLVEEGKLYLFQIYNKDFSAFSKGKPNLHTMYWKALFEPRNLQDVVYKLNGQAEMFYRRKSIDEPVVHKAKEPISNKNPNATKKESVFEYDVVKDRRYTVDKFQFHVPITLNFRASGGDYINGDVLDYLKNNPEVNIIGLDRGERHLIYLTLINQKGEILKQESLNSIINEQYNIETNYHQLLDDQERKRDKARKNWGSVETIKELKEGYLSQVVHKIAQMMVEYNAIVVMEDFNFGFKRGRFKVEKQIYQKLEKMLIDKLNYLVFKDAEVNEPAGLYTALQLTNKFESFQKLGKQSGFLFYVPAWNTSKIDPTTGFVNLFYTRYENVDKAKAFFGNFEDIHYNSDKNYFEFEVSNYVLFNPKAKETRLNWVVCTQGERIKTFRDSTQNNQWVSKEVALTSAFIDLFTKYQIPYQKEELKEEILSQIDKAFFKELLSLFKLTVQMRNSKTGTDIDYMISPVMNSEGGFYDSRLADDSLPKDADANGAYHIAKKGLWMLQQINKYEGEDWKKLNLAISNREWLQFVQR

SEQ ID NO: 123 - protein, 1321 aa, unidentified
MKSDFQEFTNLYPVQKTLRFALKPIGETEKSINSKGLLEKDEDIAEKYSYAKKIIDEYHRDFIRKSLSSFEFITEDLEEYKALYFLFKKDRYNKTVEKKLSAKQNQLRKLLSVALKNQDLFKKELIKTVLPAWLNENLIQLEGISNPKRIIEEFKDWTVYFKGFHENRKNIYTDKEISTSIGFRLIHENLPRFIDNIERYQKIKALGIDLSSVQKTFGVDLDTFFSLENFNTCLTQKGIDLYNLVKGGFTKNDRQKEQGINEIINLHVQSLTSELKSADDTEKQELKKKIKQVRSCTLEELYKQILSDRSSISFREDVIEYDGDLSQQILGLFTIDPETSALIAKDVSVDFETGEVFEITFNFSEELLFVLNTLKEADPAQVFIKNDNELNQISTQIFGNWSVIKNSLEYYAEHEHLGLNNKGLPKKLSQKEKDKWLKQKYFSFETVHQALELFFRQYSDADLSNQEDENGLEKGFSKEMKQKALSKPLYSYFLNLKAKIPSSRNQVLKEVQLIENILSTHGLAQAVLLKYSSEKGQQLRTNLEEVLKIKAYLDGLNKLQQFLKPLNPSLSKKDKKQSIGLNKDSTFYGRFEILCRVLGQIISLYNQTRNYLTQKPYTTEKYKLNFENSTLADGWDESKEKDNTAIIFLREGKYYLGIMDYKHKYLFSPPPEAESDDVYQKIVYKLLPTPSKMLPKVFFSKKNIAYYASSSNIRNIRNHGSHTKNGKPQKGFQKVDFSLDHCHEIIDFYKDSILIHPKWKNFGFKFSKTSNYANINEFYREVEHQGYEITSVPIDKKYIDENVKSGKLYLFEIYSKDFSPKSKGKPNLQTLYWKALFDPINLKNVVYKLNGKAELFFRKASIKYSDKVWKKGHHADSPNKKQNYPIIKDRRYAQNTYLFHASISCNFKASEVTKFNDIVNTYLKGRKDVTILGIDRGERHLAYYTLINQNGEILKQGSFNNPLGNRDYHQLLDHREKERDKARKSWGAIQKINDLKIGYISQVVHEIVRMVMEHNAIVVFENLNFGFKRGRFKVEKQVYQNLEKMLIQKLNYLVLKDLEPNAPGGWMNALQLTSPFSSFKDTGEQTGIIYYVPAYYTSRVCPATGFVNLLYPRYETVQKAQHFFGRFDSIRYLSEEDSFAFEFTYKNFTPKAEGSRQNWIIYTHGSRLENFRDPSSNNQWNTHEVHLTSELKRLFEEYSIDYQHGADLHKTIATQKSSPFFKHLIRLLKLTLKLRNSRINSEEDWMISPVKDSNGQFFDSRKSLGSVMPQNADANGAFHIGLKGLWILGQIKQWKPGKRLNLAISNKAWFKFIQEKPYQSN

SEQ ID NO: 124 - protein, 1143 aa, unidentified
MFADKAQTTAIANRVCNENLIRFFNSLLHFEQIKETFPELYQQFCQEANPQALEKLHCTKIDQVFSPDRYLLLLNQAGIDAFNTLLGRSAENPKEQGINQSRNLYLQKLTKEGDPDKKLPLLKRLLFQPLHKQILSESNRPNWVQSIDSNPAFLDALKGFKEEFGTQWHPALKQSLSKIQAADPLTIWLRGDRLQPLSRTLFKDRFHLKNALEFSIRDSEGLTKQAHLKENPNLKKKSLERWEQKTLESLEQDDGAPQSIGRLDQLLNDYHHQNPSSLDPESPTDKAFTENPLQRHFSTTLGNRLDQSLEKLEKLWQSLRPLENRSEEDLPKNRGKDVLPIKEIKDTLDDCLYLSRELAYLHLLKKGTPIEVPENNHDFYQSFDEAFSPYNDALQTLYNQTRNYLSKKPYSSEKLKINFEKATFLDGWDVNKENDNRGVILQRKDSYYLAILRKEKSITPDSLFVEPPSAKKHPDAYQKMYYKQVTGANKMLPKNFFGEKGRRQYQPPAAIIRIYKNKEYVLGDNFKLDSCHQLIDFYKKHLPTYKSKPTDRYGWEVFNFKFSPTNTYQNIDQFFQEFEQQSYRIWFRPIDPQTVAQAVQNGDLFLFQIYNKDFSPYSKGRPNLHTLYWRSLFLEENWQKPIVKLNGKAEVFFRPRSLEAKKQPTHPPGQALENKNPHNPKRQSTFAYPLIKDKRYTADKFFLHLPITLNPLQKTKGNGETKVFNLQVNQALGKSPHSHIIGIDRGERNLLAYTVIDPSGTIVEQGDLNQIHTDQGYPVDYHQKLDKIEKQRDQARKSWETIDHIKELKAGYLSHVIHRLARMVVQYDAILCLENLQYGFKRGRFKVEKQVYHKFEKALIDKFNHLVFKEAPAGQPGHFLNALQLTLPCPTLQDIQRQNGILFYVRAAYTSKICPATGFVNFLDLRYQSLQQSIQFFEQIQDFRYCPKHQRFELDFDYCKIKPFTRGWHGGGQSEWRLGTHGTLRYRSQAHKKTQKRESIPVDSTAQLKQLLKEGGIPYKDTDLSKKIVQFGKNPASPRRSWFFKNLFYELKTAFSLRHSKVGSAEDFILSPVISEDGSYFDSRQNQPAYPANADQNGAYHIALKGLWYLRSFQKKPPTRPIETLKDVDWVPFAQEVAKTRRP

SEQ ID NO: 125 - protein, 1250 aa, unidentified
MISLNYFQNQYAVAKTLCLELRPIEKTMEYIISSGILKEDEHRNESYKLVKKIIDDYHKAYIELSLSRFELKITSCSKNDALEDFYCQYLANSQEEKDKNIFKKTQDNLRKQIAKHLTQGEAYKRIDKKELIQEDLLEFVAADPDAANKKILINEFRDFTTYFTGFYENRKNMYSEEAQSTAIAYRIIHENLPKFIDNMGTFKQLMQSSITDILPQIFDNFKKDLEVSSIQEIFDLNYFNKVLTQKQIDIYNAIIGGKSLNENSRIQGLNEYINLYNQQHKENKLPLLKLLFKQILSDRNSLSWLPEAFETDKQVLHAVRKCYANLKESVLHEAGLVQLLSSLPSYDSTRIYIRNDQALTTISQKLFGDWGIIPHAIKERLKKDISAKRKETEEAYLERIEKAFKQADSYTIAYINDSLKEIGVDKKNIEDYFIHLGAICTEGQEQENILQRIASAYSQAQPLLEEKVPVHKNLMQDKDSVELIKSLLDELKNLQHFIKPLLGKGSESDKDERFYGEFVGLWNELDQITTLYNKVRNYVTRKPYSIEKFKINFQNATLLKGWDRNKERDNTSIILRKNGLYYLAIMRKEYNKVFEKYPAGTEENCYEKMEYKLLPGANKMLPKVFFSKSRINEFNPSPQLLQNYQMGTHKKGDQFKKEDCHALIDFFKTSIEKHEDWKNFNFQFSPTSVYEDMSGFYREVEQQGYKLVFRSIDAEYIDKLVEEGKIFLFQIYNKDFSPFSKGTPNLHTLYWKMLFDERNLNNVVYKLNGEAEIFFRKKSITYTHPTHPAEIPIKNKNVQNKKKESVFQYDLIKNHRFTIDSFQFHVPITMNFKNAGLSNLNEQVYTYLRENKDAHIIGIDRGERHLLYLVVIDRYGRIVKQFSLNEIVNEYHGNTYTTNYHDLLDKREEARQQARQSWQSIENIKELKEGYLSQVVHKIANLMVEYHAIVVLEDLNIGFMRGRQKVEKQVYQKFEKMLIDKLNYLVDKKKAPEADGGLLKAFQLTNQFESFQKLGKQSGSLFSVPGWNTSKIDPCTGFTNLLDTRYENIAKAQKFFRTFDAIRYNAVKDYFELELDYDKFHKRAEGTQTKWTLCTYGTRIKTFRNPENNNQWDNVEINLTEEFKKLFKQFGINLSGDLQQAICAQTEKSFFESLLRLLKLTLQMRNSITGTDVDYLLSPVQNAEGYFYDSRKGDKSLPANADANGAYNIARKGLWVIQQIKQTPQGQKAKLSISNKEWLKFAQEKPYLKD

SEQ ID NO: 126 - protein, 1251 aa, unidentified
MNTFNGFTGLYPLSKTLRFELKPIGKTLQFIINNGILEQDKHRADSYSQVKEIINEYHKAFIERGLTGFELKYNNEGKKNSLLEYFMYYNIKNREERDKNTYKQIQNNLRKQITDRLSKDEAFQRINKKELIQQDLISFVETQPNSAKKRALVEEFRNFTTYFSGFHENRKNMYSAEEKSTSIAYRLINENLPKFVDNIQVFSKVMGTEISKKMPQLYQEFQKFLNVENIEEMFHLKYFSSTLTQSQIDVYNAIIGGITSDDNVRIKGLNEYINLYNQQHKDTKLPKLKLLLKQILSERNPVSWLPEKFDSDEQMLTAIKQCYENLSERVFGNTSLRLQLELLGDFDLNGIFISNDPQLADISQKIFGNWGIIQKAIQTKIANCLPQKRKESFEDYQERITKRFKSFDSFSIGYIEECLSAVGIPSNKIEKYFSDLGVVNNRIEQKENHFVRIANAYEEIRDLLNNPYPMEKRLSQDKAHVEKIKQLLDAIKALQHFIKPLLSGGDEPNKDERFYGEFTALWNELDQITPLYNMVRNYITRKPYSEKKIKLNFENSTLMDGWDLNKEKDNTTIILRKDNLYYLGIMNKKFNKIFDKYPGSTSDEYYEKMEYKLLPGANKMLPKVFLLSKSGLDEFNPSQEIRDNYEKGTHKKGINFKLEDCHALIDFFKTSINKHSDWKKFDFKFSETSTYEDLSGFYKEVEQQGYKVSFRNVSANYIDTLIDEGKLYLFQIYNKDFSPYSKGIPNMHTLYWKMLFDEQNLENVVYKLNGQAEIFYRESSLEYHHPTHPANQPVMNKNQSNVKQESVFPYDLIKNRRYTIDKFQFHVPITMNFKSNGVNNINQQVNECLQHADDTHIIGIDRGERHLLYLVVIDKKGNIKEQCSLNEIMNEYNGNRYSTDYHNLLNRREDERLKARQSWQSIESIKDLKEGYLSQVIHKISELIVKYNAIVVLEDLNLGFIRGRQKIEKQIYQKFEKMLIDKLNYLVDKKKEPNELGGILKAYQLANKFESFQKMGKQSGFLFYIPAWNTSKIDPQTGFVNLLDVHYESTEKAKSFFCKFDSIKYNTSKDWFEFELDYSKFNQKAEGTRIHWTLCSYGTRIETLRYVSKNSQWDSVEVNLTEKFKEHFNKYHIDIHTNLKEAISRQIEKNFFEGLLHLLKLTLQMRNSKIGADIDYLISPVADDNGIFYDSRSCDPSLPANADANGAYNIARKGLWILKQIKETVDLKKLKLTISNKEWLRFAQEKPYLND

SEQ ID NO: 127 - protein, 1265 aa, unidentified
MIKLIATDMDGTLLNSNNSSLKLDAFTGKYSLSKTLRFKLLPIGNTLSNIISSGILEEDQHRAESYIKVKAIIDEYHKAYISLMLQDFKLKYENTGNLNSLEEYFYYYHLGSKDEKEQKCFEKIQQSLRKQIADRLTKDERFKRIDKKELIQEDLIEFVQGDADSDQKVSLISEFQNFTVYFTGFHENRKNMYSADEKSTAIAYRLIHENLPRFIDNMQVFASIASTEIAEKFSELYKNFEEYLQVIKIDDLFQLDYFTMILTQKHIDVYNAIIGGKTTKNGEKIQGLNEYINLYNQHHKDKKLPKFKTLFKQILSDREAISWLPDTYKNDREVILAINEFYATLQSTVLGSGALRILLENISSYDLSGVYVRNDQQLTEISQRMYGHWSAIQNAIKKELENTLPQKKKESYEDYQTRIDKLYKSKSSFSISFINHCLQNIASAGIEEYFKTLGAVQNETTQMENHFARITNAYTDAEEILHKDWNTERKLLQDAEATQKIKQLLDTIKGLQLFIKPMLGSGDEANKDERFYGELAEFWNELDLLTPLYNKVRNYVTQKPYSEEKIKLNFKNPTLLKGWELNKETDYTSVILRRNGLYYLAIMNKKHNKVFSSYPSGDEKSSYEKMEYKQLPNPYMNLPRVFISSESGSAIFKPSKEIQERYQRGTHAKGDNFNLEDCHALIDFFKQSLNKHEDWKQFNFHFSETSSYSDISKFYREVSDQGYKLTFSKISSEYIDQLVEEGKIYLFQIYNKDFSSYSKGTPNMHTLYWKMLFDEKNLSDVVYKLNGEAEVFFRKSSIKSVHPTHPANQPVKNKNILNEKKESVFAYDLIKDKRYTVDQFQFHVPITMNFKATGSGNINSEVNTYLRNTDDLHVIGIDRGERHLLYLVVTDMQGQICEQFSLNEIITEYNGRKYATNYHELLQRKEDERLKARQSWQSIENIKELKEGYLSQVVHKISELMVKYNAIVVLEDLNSGFMRGRQKVEKQVYQKFEKMLIDKLNYLVFKKNQADQPGGVLHAYQLTNKFESFAKLGKQCGFLYYIPAWNTSKMDPTTGFVNLFDVHYESVDKAKAFFSKFTSIRYNAQQDWFEFSFDYSNFTKKAEGTRSQWTLCSYGTRVKTFRNEAKNSQWDSKEIVLTEEFKKLFDEAGVDIHANIKEELANTVGKEFFISFIELFKLMLQIRNSVTGTETDYLISPVRNKQGAFYDSRTANEQLPQNADANGAYNIARKGLMLIERIRNAEESSKPDLKITNKDWLIYAQEIDK

SEQ ID NO: 128 - protein, 1273 aa, unidentified
MDKNFDDFKRLYPLSKTLRFEAKPIGATLKNIIKSGLLEEDEHRAQSYVKVKKLIDEYHKAFIDRVLNEGCLTIENKGNKDSLEEYYESYMSKSNDENVSKTFKEIQENLRSVIANKLTKDKGYANLFGNKLIESYKDKDDTKKIIDSDLIQFINTAEPSKLDSMSQDEAKGVVKEFWGFTTYFEGFHKNRKNMYTSEEKSTGIAYRLVNENLPKFIDNMEAFKKAIAKPEIQANMEELYSNFAEYLNVESIQEMFQLDYYDMLLTQKQIDVYNAIIGGKTDEDHDVKIKGINEYINLYNQQHKDEKLPKLKALFKQILSDRNAISWLPEEFNSDQEVLDAIKDCYERLSENVLGDKVLKSLLCSLSDYNLNGIFVRNDLQLTDISQKTFGHWSVIQNAIMQNIKNVAPARKRKESEEDYEKRISDIFKKADSFSIQYINDCLNEMDDNNLHAVDGYFATLGAVNIPTMQRENLFALIQNAYTDISDLLDTPYPENKNLAQDKTNVAKVKALLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKQIVENYNNGTHKKGKNFNINDCHDLIDYFKQSIDKHEDWSKFGFNFSDTSTYEDLSGFYREVEQQGYKLSFTNISVSFINKLVDEGKMYLFQIYNKDFSDYSKGTPNMHTLYWKALFDERNLADVVYKLNGQAEMFYRNKSIDYTHPTHPANHPIQNKNKDNKKKESVFEYDLVKDRRYTVDKFLFHVPITMNFKSVGSENINQKVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADATQSGGLLNAYQLTSKFDSFQKLGKQSGFLFYIPAWNTSKIDPVTGFVNLLDTSYQNTEKAKAFFSKFDAIRYNADKDWFEFNLDYDKFGTKAEGTRTKWTLCTQGNRICTFRNAEKNSQWDNQEVDLTRELKSLFEHYHFNICGNLKEEICSQTDKAFFTGLLHILKLTLQMRNSITGTETDYLVSPVADENGVFYDSRSCGDTLPENADANGAYNIARKGLMLIRQIKEAKELDKVKFDISNKAWLNFAQQKPYKK

SEQ ID NO: 129 - protein, 1274 aa, unidentified
MAKNFEDFKRLYPLSKTLRFEAKPIGATLDNIVKSGLLDEDEHRAASYVKVKKLIDEYHKVFIDRVLADGCLPLENEGHNNSLAEYYDSYVSKSQNEDAKKAFEENQQNLRSIIAKKLTEDKAYANLFGKNLIESYKDKTDKTKIIDSDLIQFINTAESTQLNSMSQDEAKELVKEFCGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDNKLPKFKALFKQILSDRNAISWLPEEFNSDQEVLNAIKDCYERLSENVLGDKVLKSLLGSLSDYTLDGIFIRNDLQLTDISQKMFGNWCVIQNSIMQNIKHVAPARKHKESEEDYEKRIAGIFKKADSFSISYINDCLNEADSNNAYFVENYFATFGAVNTPTMQRENLFSLVQNAYTEVAALLHSDYPTAKNLAQDKANVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREDERLKARQSWQTIENIKELKEGYLSQVIHKITQLMVKYHAIVVLEDLNKGFMRGRQKVEKQVYQKFEKMLIDKLNYLVDKKADASVSGGLLNAYQLTSKFDSFQKLGKQSGFLFYIPAWNTSKIDPVTGFVNLLDTRYQNVEKAKVFFSKFDAIRYNKDKDWFEFNLDYDKFGKKAEGTRTKWTLCTRGMRIDTFRNKEKNSQWDNQEVDLTAEMKSLLEHYYIDIHDNLKDAISAQTDKVFFTGLLHILKLTLQMRNSITGTETDYLVSPVADENGIFYDSRSCGDELPENADANGAYNIARKGLMMIEQIKEVKDLDNLKFDISNKSWLNFAQQKPYKNE

SEQ ID NO: 130 - protein, 1274 aa, unidentified
MAKIFEDFKRLYPLSKTLRFEAKPIGATLDNIIKSGLLDEDEHRAASYVRVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLSDYSLDGIFIRNDLQLTDISQKMFGNWCVIQNAIMQNIKHVAPARKHKESEEDYEKRIAGIFKKVDSFSISFINDCLNEADPNNAYFVENYFATFGAVNTPTMQRENLFALVQNAYTEVAALLHSDYPTAKHLAQDKVNVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFTRVSVSYISQLVEEGKMYLFQIYNKDFSEYSKGTPNMHTLYWKALFDERNLADVVYKLNGQAEMFYRKKSIENSHPTHPANHPILNKNKDNKKKESLFDYDLIKDRRYTVDKFMFHVPITMNFKSSSSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPITGFVNLLDTRYQNVEKAKVFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKEAKDLDNLKFDISNKSWLNFAQQKPYKNE

SEQ ID NO: 131 - protein, 1274 aa, unidentified
MARIFEDFKRLYPLSKTLRFEAKPIGATLDNIVKSGLLDEDEHRAESYVKVKKLIDEYHKVFIDRVLDNGCLPLKNEGHNNSLTEYYDSYVSKSQNEDAKKAFEENQQNLRSIIAKKLTEDKAYANLFGKNLIESYKDKTDKTKIIDSDLIQFINTAESTQLNSMSQDEAKELVKEFWGFTTYFVGFFDNCKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSYYPAEKKLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMDKDSRKLLGKAMPSDGECYEKMVYKLLPGANKMLPKVFFAKSRMDDFKPSKELIEKYNNGTHKKGKNFDIQDCHNLIDYFKQSIDKHEDWSKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDAREDERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWILCTRGMRIDTFRNKEKNSQWDNQEVDLTAELKSLLEHYYIDIHGNLKEAISAQTDKAFFTGLLHILKLTLQMRNSITGTETDYLVSPVADENGIFYDSRSCGEQLPENADANGAYNIARKGLMMIEQIKNAEDLGNLKFDISNKAWLNFAQQKPYKNG

SEQ ID NO: 132 - protein, 1274 aa, unidentified
MAKNFEDFKRLYPLSKTLRFEAKPIGATLDNIIKSGLLDEDEHRAASYVKMKKLIDEYHKVFIDRVLDNGCLPLKNEGQNNSLTEYYESYVSKSQNEDAKKAFEENQQNLRSIVAKKLTDDKAYANLFGKNLIESYKDKEDKKKIIDSDLIQFICTAEATQLDSMSQDEAKEIVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSDYPTAKHLAQDKANVAKIKALLDAIKSLQHFVKPLLGKGDESDKDERLYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSINKHEDWGKFGFNFSDTSTYEDLSGFYREVEQQGYKLSFARVSVSYINQLVEEGKMYLFQIYNKDFSEYSKGAPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISTQTDKAFFTGLLHILKLTLQMRNSITGTETDYLVSPVADENGIFYDSRSCGEELPENADANGAYNIARKGLMLIEQIKGAEDLGNLKFDISNKAWLNFAQQKPYKNG

SEQ ID NO: 133 - protein, 1274 aa, unidentified
MAKNFEDFKRLYPLSKTLRFEAKPIGATLDNIVKSGLLDEDEHRAASYVKVKKLIDEYHKVFIDRVLADGCLPLKNEGHNNSLTEYYDSYVSKSQNEDAKKAFEENQQNLRSIIAKKLTEDKAYANLFGKNLIESYKDKEDKKKIIDSDLIKFINTAESTQLDSMSQDEAKEIVKEFWGFTTYFVGFFDNRKNMYTAEEKSTGIAYRLINENLLKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQNIKRVAPARKHKESEEDYEKRIAGIFKRADSFSISYINDCLNEADPNNAYFVENYFATFGAVNTPTMQRENLFALVLNAYTEVASLLHSYYPAEKNLAQDKANVAKIKALLDAIKSLQHFVKPLLGKGDESDKDERFYGELASLWAELETVTPLYNMIRNYMTRKPYSQKKIKLNFENPQLLGGWDANKEKDYATIILRRNGLYYLAIMDKDSRKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDAREDERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAELKSLLEHYYIEIHGNLKEAISAQTDKAFFTGLLHILKLTLQMRNSITGTETDWLVSPVADENGIFYDSRTCGDELPENADANGAYNIARKGLMMIEQIKNAEDLGNLKFDISNKAWLNFAQQKPYKNG

SEQ ID NO: 134 - protein, 1249 aa, unidentified
MTNNSSLKLDAFTGKYSLSKTLRFKLLPIGNTLSNIISSGILEEDQHRAESYIKVKAIIDEYHKAYISLMLQDFKLKYENTGNLNSLEEYFYYYHLGSKDEKEQKCFEKIQQSLRKQIADRLTKDKRFKRIDKKELIQEDLIEFVQGDADSDQKVSLISEFQNFTVYFTGFHENRKNMYSADEKSTAIAYRLIHENLPRFIDNMQVFASIASTEIAEKFSELYKNFEEYLQVIKIDDLFQLDYFTMILTQKHIDVYNAIIGGKTTKNGEKIQGLNEYINLYNQHHKDKKLPKFKTLFKQIDREAISWLPDTYKNDREVILAINEFYATLQSTVLGSGALRILLENISSYDLSGVYVRNDQQLTEISQRMYGHWSAIQNAIKKELENTLPQKKKESYEDYQTRIDKLYKSKSSFSISFINHCLQNIASAGIEEYFKTLGAVQNETTQMENHFARITNAYTDAEEILHKDWNTERKLLQDAEATQKIKQLLDTIKGLQLFIKPMLGSGDEANKDERFYGELAEFWNELDLLTPLYNKVRNYVTQKPYSEEKIKLNFKNPTLLKGWELNKETDYTSVILRRNGLYYLAIMNKKHNKVFSSYPSGDEKSSYEKMEYKQLPNPYMNLPRVFISSESGSAIFKPSKEIQERYQRGTHAKGDNFNLEDCHALIDFFKQSLNKHEDWKQFNFHFSETSSYSDISKFYREVSDQGYKLTFSKISSEYIDQLVEEGKIYLFQIYNKDFSSYSKGTPNMHTLYWKMLFDEKNLSDVVYKLNGEAEVFFRKSSIKSVHPTHPANQPVKNKNILNEKKESVFAYDLIKDKRYTVDQFQFHVPITMNFKATGSGNINSEVNTYLRNTDDLHVIGIDRGERHLLYLVVTDMQGQICEQFSLNEIITEYNGRKYATNYHELLQRKEDERLKARQSWQSIENIKELKEGYLSQVVHKISELMVKYNAIVVLEDLNSGFMRGRQKVEKQVYQKFEKMLIDKLNYLVFKKNQADQPGGVLHAYQLTNKFESFAKLGKQCGFLYYIPAWNTSKMDPTTGFVNLFDVHYESVDKAKAFFSKFTSIRYNAQQDWFEFSFDYSNFTKKAEGTRSQWTLCSYGTRVKTFRNEAKNSQWDSKEIVLTEEFKKLFDEAGVDIHANIKEELANTVGKEFFISFIELFKLMLQIRNSVTGTETDYLISPVRNKQGAFYDSRTANEQLPQNADANGAYNIARKGLMLIERIRNAEESSKPDLKITNKDWLIYAQEIDK

SEQ ID NO: 135 - protein, 1272 aa, unidentified
MKFNDFKKLYQLSKTLRFEARPIGSTLKHIIENGLLEEDEHRAQSYVKVKKLIDEYHKAFIDRVLNEGCLTIENKGNKDSLEEYYESYMSKSNDENVCKTFKEIQENLRSVIANKLTKDKGYSNLFGNKLIESYKDKDDTKKIIDSDLIQFINTAEPSKLDSMSQDEAKELVKEFWGFTTYFIGFFDNRKNMYTSEEKSTGIAYRLINENLPKFIDNMEAFKKAIAKPEIQASMGELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQEVLNAIKDCYERLSENVLGDKVLKSLLCSLSDYNLNGIFVRNDLQLTDISQKMFGNWSVIQNAIMQDIKTVAPARKRKESEEDYEKRISDIFKKADSFSIQYINDCLNEMDENNLHAVDGYFATLGAVNSPTMQRENLFALIENAYTDISDLLNKEYPNEKNLAQDDINVAKIKNLLDAIKQLQHFVKPLLGKGDESDKDERFYGELASLWTELDTVTPLYNMVRNYMTRKPYSDKKIKLNFENSQLLGGWDANKEKDYASIILRREGKYYLAIMDKNSKKLLGKAMPSDGDCYEKMVYKLLPGANKMLPKVFFAKSRMGDFKPSKQIIEKYNNGTHKKGKTFNIQDCHNLIDYFKRSINKHEDWSKFGFNFSDTSTYEDLSGFYREVEQQGYKLSFTNISAAFIDNLVDEGKMYLFQIYNKDFSEYSKGTPNMHTLYWKALFDERNLADVVYKLNGQAELFYRKKSIDNTHPTHPANLPIQNKNKDNNKKESLFEYDLVKDRRYTVDKFMFHVPITMNFKSVGSENINQQVREYLQQADDTHIIGIDRGERHLLYLVVIDMQGNIKEQFTLNEIVNEYNGNTYRTNYHDLLDKREEERLTARQSWQTIENIKELKEGYLSQVIHKITQLMVKYHAVVVLEDLNKGFMRGRQKVEKQVYQKFEKMLIDKLNYLVDKKADASQPGGLLNAYQLTSKFDSFQKLGKQSGFLFYIPAWNTSKIDPVTGFVNLLDTRYQNTEKAKAFFSKFDIIRYNVNKDWFEFNLDYDKFGTKAEGTQTRWTLCTRGTRICTFRNSDKNSQWDNKEIDLTKEMKALFELYHIDICGNLKESICSQTDKTFFTGLLHLLKLVLQMRNSITGTETDYLVSPVADENGNFYDSRFCDNTLPLNADANGAYNIARKGLMLIEQIKETKDLANIKYDISNKAWLNFAQQKPYKNE

SEQ ID NO: 136 - protein, 1274 aa, unidentified
MAKNFEDFKRLYPLSKTLRFEAKPIGATLDNIVKSGLLDEDEHRAASYVKVKKLIDEYHKVFIDRVLDNGCLPLEDKGDNNSLAEYYDSYVSKSQNEDAKKAFKEIQQNLRSIIAKKLTDDKAYANLFGNKLIESYKDKADKTKIIDSDLIQFIHTAESTQLDSMSQDEAKELVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKHVAPARKHKESEEDYEKRIAGIFKKADSFSISYINDCLNEADPNNAYFVENYFATFGAINTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFCIQDCHNLIDYFKQSIDKHEDWSKFGFNFSETSTYEDLSGFYREVEQQGYKLSFARVSVSYINQLVEEGKMYLFQIYNKDFSEYSKGTPNMHTLYWKALFAERNLADVVYKLNGQAEMFYRKKSIENTHPTHPANHPILNKNKDNKKKESLFEYDLIKDRRYTVDKFMFHVPITMNFKSSGSENINQDVKAYLRYADDMHIIGIDRGERHLLYLVVIDLQGNIKEQVSLNEIVNDYNGNTYHTNYHDLLDVREDERLKARQSWQAIENIKELKEGYLSQVIHKITQLMVKYHAIVVLEDLNMGFMRGRQKVEKQVYQKFEKMLIDKLNYLVDKKADVSVSGGLLNAYQLTSKFDSFQKMGKQSGFLFYIPAWNTSKIDPITGFVNLLDTRYQNVEKAKVFFSKFDAIRYNKDKDWFEFNLDYDKFGKKAEGTRTKWALCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKEAKDLDNLKFDISNKSWLNFAQQKPYKNG

SEQ ID NO: 137 - protein, 1272 aa, unidentified
MKFDDFKKLYSLSKTLRFEAKPVGSTLKNIIESGLLEEDEHRAQSYVKVKKLIDEYHKVFIDRVLNDGCLTIENKGKKDSLEEYYESYMSKSNDENVSKTFKEIQENLRSVIAKKLTDDNAYANLFGNKLIESYKDKDEKNKIIDSDLIQFINTAEPSQLDSMSQDEAKELVKEFWGFTTYFVGFFDNRKNMYTSEEKSTGIAYRLVNENLPKFIDNMEAFKKAIAKPEIQASMEELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQEVLNAIDDCYKRLSENVLGDKVLKSLLCSLDDYNLDGIFVRNDLQLTDISQKMFGNWSVIQSAIMQNIKNVAPARKRKESEEDYEKRISDIFKKADSFSIQYINDCLNEMDNNNLHAVDGYFATLGAVNTPTMQRENLFALIQNAYTDISNLLETPYPENKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLAIMDKDSKKLLGKTMPSNGECYEKMVYKLLPGANKMLPKVFFAKSRINDFKPSKLIVENYNNGTHKKGKNFNINDCHNLIDYFKQSIDKHEDWSKFGFNFSDTSTYEDLSGFYREVEQQGYKLSFTNVSVSFIDKLVDEGKMYLFQIYNKDFSDFSKGTPNMHTLYWKALFDERNLADVVYKLNGQAEMFYRKKSINNTHPTHPANHPIQNKNKDNKKKESVFEYDLIKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKAKAFFSRFDAIRYNANKDWFEFYLDYDKFCTKAEGTRTRWTLCTQGSRISTFRNAEKNSQWDNLEVDLTREMKSLFEHYHINICGNLKEEICLQTDKAFFTGLLHMLKLTLQMRNNITGTETDYLISPVADENGTFYDSRSCGDTLPKNADANGAYNIARKGLMFIGQIKETKDLANFKYDISNKAWLNFAQQKPYKNE

SEQ ID NO: 138 - protein, 1274 aa, unidentified
MAKNFEDFKRLYPLSKTLRFEAKPIGATLDNIIKSGLLDEDEHRAASYVKMKKLIDEYHKVFIDRVLDNGCLPLEDKGDNNSLAEYYESYVSKAQDEDAIKKFKEIQQNLCSIIAKKLTDDKAYANLFGNKLIESYKDKADKTKIIDSDLIQFINTAESTQLVSMSQDEAKELVKEFWGFTTYFEGFFKNRKNMYTPEEKSTGIAYRLINENLPKFIDNMEAFKKAIARPEIQANMEELYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLCSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDVREDERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDMSNKAWLNFAQKKPYKNG

SEQ ID NO: 139 - protein, 1274 aa, unidentified
MAKNFEDFKRLYPLSKTLRFEAKPIGATLDNIIKSGLLDEDEHRAASYVKMKKLIDEYHKVFIDRVLDNGCLPLEDKGDNNSLAEYYESYVSKAQDEDAIKKFKEIQQNLCSIIAKKLTDDKAYANLFGNKLIESYKDKADKTKIIDSDLIQFINTAESTQLVSMSQDEAKELVKEFWGFTTYFEGFFKNRKNMYTPEEKSTGIAYRLINENLPKFIDNMEAFKKAIARPEIQANMEELYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLCSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQCVKEYLHHADDMHIIGIDRGERHLLYLVVIDLQGNIKEQYSLNEIVNEYNGNTYHTNYHDLLDVREDERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDMSNKAWLNFAQKKPYKNG

SEQ ID NO: 140 - protein, 1271 aa, unidentified
MEYENFKKIYPLSKTLRFEAKPVGSTLKNFIESGLLEEDEHRAQSYVKVKKLIDEYHKVFIDRVLNDGCLPLENKGNKNSLEEYYESYLSKNRDENANNTFKEIQQNLRSVIAKKLTDDKAYANLFGNKLIESYKDKEDKKKIIDSDLIQFINCANSSQLNGMSEDEAKELVKEFWGFTTYFEGFHTNRKNMYTAEEESTAIAHRLVNENLPKFIDNMDVFKKAVAKPEIQANIEELYANFAAYLNVESIQEMFQLDYYNMLLTQKQIDVYNAIIGGKTDEDHDVKIKGINEYINLYNQQHKNEKLPKLKVLFKQILSDRNAISWLPEEFNDDQEVLNAIKDCYERLSENVLGDKVLKSLLCSLGDYNLDGIFVRNDAQLTDISQKMFGDWGVIQNAIIQNIKNVAPARKRKESEEDYEKRISDIFKKADSFSLRYINDCLNEMDEKNPYTVQWYFSTLGAVNTPTMQRENLFALIQNAYTDISDLLNSQYPTDKNLSQDKTNVAKVKALLDAIKSLQHFVKPLLGRGDESDKDERFYGELASLWTELDTVTPLYNMVRNYMTRKPYSEKKIKLNFENPQLLGGWDANKEKDYASIILRRNGLYYLAIMNKESKKLLGKTMPSDGECYEKMVYKLLPGANKMLPKVFFSKSKIDYFKPSKQIVENYNNDTHKKGKNFNINDCHDLIDFFKQSIDIHEDWSKFGFKFSDTSTYKDLSGFYREVEQQGYKLSFTKVSVSFIDKLVDDGKMYLFQIYNKDFSKYSKGTPNMHTLYWKALFDERNLADVVYKLNGQAEMFYRKKSIVYTHPTHPANHPILNKNKENKKKESVFEYDLVKDRRYTVDKFLLHVPITMNFKSVGSENINQQVREYLQQAEDTHIIGIDRGERHLLYLVVIDMQGNIKEQYTLNEIVNEYNGNTYRTNYHDLLNTREEERLTARQSWQTIENIKELKEGYLSQVIHKITQLMVKYHAVVVLEDLNKGFMRGRQKVEKQVYQKFEKMLIDKLNYLVDKKADAAQLGGLLNAYQLTSKFDSFQKLGKQSGFLFYIPAWNTSKIDPVTGFVNLLDTRYQNTEKAKAFFSKFDAIRYNADKDWFEFYLDYDKFGTKAEGTRTKWTLCTQGCRIRTFRNADKNSQWDNQDVDLTKELKALFEIYHINIGGNLKEGICSQTDKAFFTGLLHILKLTLQMRNSITGTETDYLVSPVADENGVFYDSRSCGDTLPKNADANGAYNIARKGLMLIEQIKETKDLANFKYDISNKAWLNFAQQKPYEK

SEQ ID NO: 141 - protein, 1256 aa, unidentified
MKNLKQFCKLYQLSKTLRFELIPQGKTLDYILRNGLLEKDQERADNYQLVKKMIDNYHKNYIEQALKDFQFNKEDKEQKDSLSEYFMYYHLKNNDPMRTEALKSINENLRKQLVRKLLASDAFSRIDKKELIREDLLNFLTSEEDKALVKGFKEFTTYFTGFHENRKNMYSEEEKSTSIAYRIVHENLPKFIDNMDIFSKLMSVPEMKINIEQLYKDFKDYLNVANISEMFQLGFYDTVITQHQIEVYNLIIGGRTQNNEKRKIKGLNEYINLYNQQRANKQNKLPKLKLLYKQILSDKEAISWLPEEFKSDNEMLESIEQCYQSLANMWRGSSEEESSLISLLMGLSSYDTNHIYITAGIPLTSISQKLYDNWSAIQTAVQYDYVLHNPKKSKESEEKFAERKDKYFKSFGSFSIGYLNTCISEYYQGTPFEAIKIEDYFMALGNKEGKTLFDIIEVEYRNVKDLLNTPYPQNKSLAQDKANVENIKNLLDAIKNVQHFIKPLLGKGNEPEKDERFYGELTALWERLDTVTALYNKVRNRMTKKPYSEEKIKLNFENSTLLAGWDLNKETDNSCVILRKNGLYYLAVMDKRHNKVFQEKNLRDDGNCFEKMEYKLLPGANKMLPKVFFSKSRINEFAPSPKIIENYSKGTHKKGNNFNLEDCHELIDFFKSSLAKHEDWKKFGFKFSDTSSYEDLSGFYREVEQQGYMINFRQVSEAYIQSLVDEGKIYLFQIYNKDFSLYSKGTPNMHTLYWKMLFDEQNLKDVVYKLNGQAEIFFRKSSISYQRPTHPAKHPIANKNRFNEKRESVFDYDLIKDYRYTVDKFQFHVPITMNFKNLGMDNINSKVNEFIQSTDNIHIIGIDRGERNLLYLSLINGKGEIIKQYSLNEIQNEYQDKLCPANNYRDLLEAREAKRDKARKSWETIEGIKDLKEGYLSQAIHKITQLIVKYNAIVILEDLNFGFMRGRQKVERQVYQKFEKMLIDKLNYLVDKKQLVNEPSGVLQALQLTNKFVSFQKLGKQSGILFYVPAWNTSKIDPTTGFVNLFDTHYVNIDRAKEFFNKFDSISYNQQKDWFEFSFDYNLFTEKAKGTRTQWTLCTYGTRICTYRDSNNNSKWISKDVILSEEFKNLFAEYAVTLSSDMKTTILQISKASFFEKLMHLFKLILQIRNSRTGGDEDYLLSPVANEQGSFFDSRNCINSLPQDADANGAYNIARKGLWIVQQIKEASDLSKLNLNIKDKEWLRYAQERPYLKNFY

SEQ ID NO: 142 - protein, 1274 aa, unidentified
MAKNFEDFKRLYPLSKTLRFEAKPIGATLDNIVKSGLLDEDEHRAASYVRVKKLIDEYHKVFIDRVLDNGCLPLENKGDNNSLAEYYASYVSKSQNEDAKKAFEENQQNLRSIIAKKLTEDKAYANLFGKNLIESYKDKEDKKKIIDSDLIQFINTAESTQLDSMSQDEAKEIVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGMIQNAIMQNIKRVAPARKHKESEEDYEKRIAGIFKKADSFSISYINDCLNEADPNNAYFVENYFATFGAVNTPTMQRENLFALVQNAYTEVAALLHSDYPTVKNLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSRKLLGKAMPSDGECYEKMVYKLLPGANKMLPKVFFAKSRMEDFKPSKELVEKYNNGTHKKGKNFCIQDCHNLIDYFKQSIDKHEDWSKFGFNFSETSTYEDLSGFYREVEQQGYKLSFVRVSVSYINQLVEEGKMYLFQIYNKDFSEYSKGTPNMHTLYWKALFDERNLADVVYKLNGQAEMFYRKKSIENTHPTHPANHPIFNKNKDNKKKESLFEYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNKGFMRGRQKVEKQVYQKFEKMLIDKLNYLVDKKANVSVPGGLLNAYQLTCKSDSSQKFGKQSGFLFYIPAWNTSKIDPITGFVNLLDTRYQNVEKAKVFFSKFDAIRYNKDKDWFEFNLDYDKFGKKAEGTKTKWTLCTRGMRIDTFRNKEKNSQWDNQEVDLTAEMKSLLEHYYIDIYGNLKDAISAQTDKAFFTGLLHILKLTLQMRNSITGTEIDYLVSPVVDENGIFYDSRSCGDELPENADANGAYNIARKGLMMIEQIKDAKDLDNLKFDISNKAWLNFAQQKPYKNG

SEQ ID NO: 143 - protein, 1245 aa, unidentified
MGIFSDFTNLYPLSKTLRFKLIPVGETLKHFMDSGILEEDQHRAESYVKVKAIIDDYHRAYIESALAGFELPLESTGKYNSLEEYYMYHSIRNKTEEIQNTLSKIRASLRKQIVGQLVKNEKFKRIDKKELIQDDLIDFVRNDADADEKIGLISEFRNFTVYFKGFHENRKNMYSDEEKSTSIAFRLIHENLPKFIDNMEVFAKIANTSISDDFVAVQKELCPESVTLCEMFKLGYFNKTLSQKQIDAYNTIIGGKTTSDGDKIKGLNEYINLYNQQHRQEKLPKMKLLFKQILSDKESASWLPEKFENDSQVARAILDFWNTIRDTVLAEGGLRTVVSSLGSYCLEGVFLKNDLQLADISQKATGDWGKIAAEIKVKIESTNPQKKKESYEVYQERIDKLFKSYKSFSLAFVNDCLRGEYKIEDYFVRLGAVNTDTLQKENHFARIFNAYTDVKEVLESYANSSDTQLIQDNVSIQKLKQFLDAVKELQAYVKPLLGCGDESGKDERFYGDFVEYWNQLDLITPLYNMVRNYVTRKPYSVEKIKINFQNPTLLNGWDLNKETDNTSVILRRGGKYYLAIMNSKFRKVFLEYPSGVNRDCYEKMEYKLLPGANKMLPKVFFSKSRINEFMPDDELLSNYEKGTHKKSGNCFSLDDCHALIDFFKKSLNKHEDWKNFGFKFSDTSTYTDMSGFYKEVEHQGYKLSFKPVDAGYVDGLVDEGKIFLFQIYNKDFSESSKGTPNLHTLYWRMLFDETNLGDVVYKLNGEAELFFRKASIKVSHPTHPANVPIRKKNPMHKDEERTLKYDLIKDKRYTVDQFQFHVPITMNFKSDGSGNINQKVLEYLRAASDTHIIGIDRGERNLLYLVVIDGNGKICEQFSLNEVKVEYNGEVYSTDYHELLDVKEAERKQARQSWQSIANIKELKEGYLSQVIHKIAEMIVKYHAIVVLEDLNAGFMRGRQKVEKQVYQKFEKMLIEKLNYLVFKKQPSDLPGGLMHAYQLTNKFESFSSLGKQCGFLFYIPAWNTSKMDPVTGFVNLFDVKYESVDKAKSFFSKFESIRYNAERDLFEWKFNYGDFTKKAEGSKSDWTACSYGNRIITYRNPDKNAQWDSKEINLTACIKTLFEKFGIDLSSNLKEAIMQRDEKEFFVELISLFKLVLQIRNSLTGKDIDYLMSPVCNANGDFFDSRKVDESLPQNADANGAYNIARKGMILLDKIRECVGDKKLNLAITNKEWLSFAQGYCKNG

SEQ ID NO: 144 - protein, 1264 aa, unidentified
MNFEQFTHLYPLSKTLRFELRPVGATLAKIKEGGFLENDNHRAESYKKVKKLIDEYHKHFIEQALGDFSLTENETEGSKCLNSYLETYIQLYRSSRIEDAEKKAFEKVQAEMRKFIAKTLKGSEAYKRLFKQELIKEDLTAFLRTHGGTVADEELVEEFKNFTTYFTGFYENRENMYSEEEKSTAISYRLVNENLPKFVDNMAAFAIIAQVPEVRAMLDVMQKDLGAELDGTTIDELFTLPFFNKVLTQKQIAVYNAVIGGKVSDSHSKGESHIKGINQIVNLYNQQHKDARLPKLKMLYKQILSDREALSWLPEKFDKDADLLKAIHDGYERLASDGVLENLRTLLESMADYQAEGIFITNDQQLTRISQKMFGEWSFISEAILCALKKDVPQKRNECDEKYEERIDKMLKNHGGFSIRFIDDCVAAYVNTLDDEEQKKRFIPTVEAYFATLGAFDTEEEQTVNFFSRIQNARDALQGLLDSAYPEGRALIQDKENGALLKELLDAILALMHFVKPLLGKNENGKDERFYGELMQIWDEFDSFVPLYNMSRNYLTQKPYSEEKYKLNFENSQLLKGWDLNKEADNTSIILRKDGLFYLAIMNKKHNKLFARELPTDGDCYEKMDYKLLPGPNKMFPKVFFSKSRKAEFAPSEHIMDIYKKGSFKKGETFNLQDCHDLIDFFKASILKHEDWRQFEFKFSETEQYDDISGFYREVEAQGYKVTFRQVSVSYIDRLVNEGKLYLFQIYNKDFSSYSKGTPNMHTLYWRALFDERNLSDVVYKLNGEAEVFYRKKSIEAHPTHPANRPIKNKNKLNDKEKSLFAYDLIKDRRYSEDKFSLHVPITMNFKSVGGPNINDDVVEFLRTNENLHFIGIDRGERHLLYLTVIDSHGHILEQRTLNDVVNNYQGKDYHTDYHDLLETRERQRQEARSSWKAIENIKDLKEGYLAQVVHQIAQLMVKYHAIVVLEDLNGGFMRGRQKVERSVYQQFEKKLIDKLNYLVDKKTDAHAPGGLMNAYQLANQFKSFKSMGRQSGFIFYIPAWNTSKIDPVTGFTNLFDTRYKNVHDAQQFFSAFKSIRYNETADRFEFKFSYSDFTRKAEGSRTDWTVCTYGTRIKTFRDPQKNNEWTSKEVVLTEEFKKFFAAYHVDIHSNLKDSIAAHDEKAFFEQLLALMRLTLQIRNSKSGTDVDYLLSPVADENGVFFDSRSCGNSLPQDADANGAYNIARKGLMLVRQMREAKDLKKFKADMTNRNWLKFAQEKPYLND

SEQ ID NO: 145 - protein, 1279 aa, unidentified
MSNFNEFTHLYQLSKTLRFELKPIGETLKHFNESGILDQDEHRAESYKKVKKLIDRYHKEFMEEALRDFVFQMDDEGKNNSLSEYFFLYSLGKRTEAQDNDFKDVKKNLREQIAKYFKASPKYKNLFKQELIKEDLCNNMQCNEEEQKLVEEFHNFTTYFTGFHENRKNMYSDEEKSTAIAFRLVHQNLPKFIDNIGVFDRVRNIDEIKAGIENLQKHFETEGLFKQGEKIEDFFTLDYYSRLAVQSRIEIYNAILGGKTTEKGEKIQGLNELINLYNQQHKETHLPKMKALFKQILSDRQAVSWIEESFKSDNEVLSSVNDFYENLKQNEIFERTKELLTSVGSYDLSKVYITNDQQLTSISQQLYGSWAVIENAILAEMQNETPRKKKEDAEKYNERLKKAYSNRSSFSIAYIDQCLEAVFGENRIPVEQHFANLGKAEIETEAECGKIKIPDVFTQIEQTYSAAKSLLCNPYPKDKHLSQSDEDIEKVKNLLDALKRFQHFIKPLTGSGDEAEKDEMFYGDLAELWTEIDQLNSLYNKVRNHLTGKPYSEEKLKLNFENATLLNGWDKNKEPDNTAIILRKDGLYYLAIMNKEHNRIFASDKLPNNGECYEKVIYKLLPGANKMLPKVFLSKKGIEVFKPSQEILAIYNNGTHKKGDTFNINDCHKLIDFFKESISKHNDWKNFDFHFSDTNSYEDLSGFYREVENQGYKITFQNISSDYIDNLVNEGKLYLFQIYNKDFSTKRDLSKHKEGTPNMHTLYWQMLFDERNLNDGVYQLNGHAEVFFRKKSLNYTKPTHPANQPIAKKNPHSKNETSQFTYDLIKDKRFTMDKFLFHVPITLNFKSGETDNINAKVRQWLQKADDVHIIGIDRGERHLLYLTVIDSKGNIKEQMSLNTIENKYNGNTYAFDYHNRLDEKEKERDKAKKSWKTVENIKELKEGYLSQAIHKITQLMLKYNAIIVLEDLNIGFMRGRQKVEKQVYQKFEKMLIDKLNYLADKKKDPSEVGGVLNAYQLTSKFESFTKLGRQSGFLFYIPAWNTSKIDPVTGFVNLFDTQYKSDGKAKMFFSKFKSISYNKDKNWFEFSFDYNDFTSKADGTKTEWTVCTNGERIENFRNGETSNQWGGRTINLSQKFKSLFDEYGIDFTKDLQNSICSQSKKGFFKQLLHLFKLTVQMRNSNTETEEEKGKKDFIISPVCVDDKYYNSDIEAEKGKDEEGNWKSELPVNADANGAYNIARKGLMILNHIKQSSDPSKKQEYDLTNKAWLNFVQKGSVEGK

SEQ ID NO: 146 - protein, 1271 aa, unidentified
MEFNDFKRLYPLSKTLRFEAKPIGATLKNIIKSGLLEGDEHRAQSYVKVKKLIDEYHKVFIDRVLNDGCLTTENNGNKDSLEEYYESYMSKTNDENANKTYKEIQQNLRSVIVKKLTDDNAYANLFGNKLIESYKDKDDKNKIIDSDLIQFINTADPSQLDYMSQDEAKELVKEFWGFTTYFVGFFDNRKNMYTPEDKSTGIAYRLVNENLPKFIDNMEAFKKAVAKPEIQANMEELYSNFAGYLNVESIQEMFQLDYYNMLLSQKQIDVYNAIIGGKTDEDHDVKIKGINEYINLYNQQHKDEKLPKLKALFKQILSDRNAISWLPEEFNSDQDVLNAIDDCYKRLSENVLGDKVLKSLLCSLSDYNLNGIFVRNDLQLTDISQKMFGNWSVIQDAIMQNIKNVAPARKRKESEEDYEKRISDIFKKADSFSIQYINDCLNEMDDNNLYAVDGHFATLGAVNTPTMQRENLFALIQNAYTDISDLLDTPYPKNMNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKQIVENYNNGTHKKGKNFNINDCHNLIDYFKQSIGKHEDWSKFGFNFSDTSTYEDLSGFYREVEQQGYKLSFTNVSVSFIDKLVDEGKMYLFQIYNKDFSDYSKGTPNMHTLYWKALFDERNLADVVYKLNGQAEMFYRKKSINNTHPTHPANHPIQNKNKDNKKKESVFEYDLIKERRYTVDKFLFHVPITMNFKSVGSENINQQVREYLQQADDTHIIGIDRGERHLLYLVVIDMQGEIKEQFTLNEIVNEYNGNTYRTNYHDLLDTREEERLKARQSWQTIENIKELKEGYLSQVIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRQNTEKAKAFFSKFDAIRYNANKDWFEFNLDYDKFGTKAEGTRTKWILCTQGNRICTFRNAEKNSQWDNLKIDLTREMKSLFEHYHINICGNLKEEICSQTDKAFFTGLLHMLKLTLQMRNSITGTETDYLVSPVADENGVFYDSRSCGDALPKNADANGAYNIARKGLMLIGQIKETKDLANFKYDISNKAWLNFAQQKPYKNE

SEQ ID NO: 147 - protein, 1274 aa, unidentified
MDKKFEDFKRLYPLSKTLRFEAKPIGSTLDNIIKSGLLDEDEHRAVSYVKVKKLIDEYHKSFIDRVLDEGCLPFENNGEKDSLEEYYESYKLKSNDENANKTFKEIQQNLRSVIANKLTDDKAYANLFGNKLIESYKDKEDKKKTIDSDLIQFINTAEPSQLDSMSQDEAKELVKEFWGFTTYFVGFFDNRKNMYTSEEKSTGIAYRLVNENLPKFIDNMEAFKKVIAKSEIQANIEELYSNFAEYLNVESIQEMFQLDYYNMLLTQKQIDVYNAIIGGKTDEKHDVKIKGINEYINLYNQQHKDEKLPKLKALFKQILSDRNAISWLPEEFNDDQEVLNAIKDCYERLSENVLGNKVLKSLLCSLADYNLDDIFIRNDLQLTDISQKMFGNWSVIQDAIIQNIKNVAPARKRKESEEDYEKRISGIFKKADSFSILYINSCLNEMDDNSLHAVDGYFATLGAVNTPTMQRENLFALIQNAYTDISDLLNTKYPANKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYSTIILRRNGMYYLAIMNKDSRRLLGKAMPSDGECYEKMVYKLLPGANKMLPKVFFAKSRIDDFKPNIQIVENYNNGTHKKRKNFNIQDCHDLIDFFKQSIKKHEDWSKFSFNFSDTSTYEDLSGFYREVEQQGYKLSFMNVSVSFIDKLVDEGKMYLFQIYNKDFSEYSKGTPNMHTLYWKALFDERNLADVVYKLNGQAEMFYRKKSIDYTHPTHPANHPILNKNKDNKKKESLFEYDLIKDRRYTVDKFLFHVPITMNFKSVGSENINQQVREYLQQADDTHIIGIDRGERHLLYLVVIDMQGNIKEQFTLNEIVNEYNGNTYRTNYHDLLDIREEERLAARQSWQTIENIKELKEGYLSQVIHKITQLMVKYHAIVVLEDLNMGFMRGRQKVEKQVYQKFEKMLIDKLNYLVDKKADATQPGGILNAYQLTSKFDSFQKLGKQSGFLFYIPAWNTSKIDSVTGFVNLLDTRYQNTEKAKVFFSKFDAIRYNEEKDWFEFYLDYDKFGSKAEGTRTKWTLCTQGKRIRTFRNPDKNSQWDNQEVDLTREMKSLFEHYHINICGNLKEEICSQTDKAFFTGLLHVLKLTLQMRNSITGTETDYLVSPVADEEGNFYDSRYCNITLPKNADANGAYNIARKGLMLVKQIKAATDLANFKYDISNKAWLNFAQQKPYKNE

SEQ ID NO: 148 - protein, 1276 aa, unidentified
MIKKDMTMYFDDFKKLYPLSKTLRFEAKPVGPTFKHIKERGLLEEDEHRAISYVKVKKLIDEYHKAFVGKALNNGCLLYESCGNKNSLIEYYETYKSKEGEARKTMKEIQKNLREMIVGAFEKEEDYANLFKGGLIEPYKSGGKHKEPDILRLINTAGFSQLAGMSQEEAKSLIKEFWRFTTYFVGFFDNRGNMYTSEEKSTGIAYRLINENLPRFIDNMEIFNKIIGKSEIQARVTELYSDFEGYLNVGSIQEMFKLDYYNALLTQKQIDVYNAIISGRTTTGPESKKIKGLNEYINLYNQQHKDGKLPKFKPLFKQILSDREALSWLPDEFVNDQEMLNAIKNCYEKLTGNILGESALKVLLGSLADYDLGGIFVRNDSQLTNISQRMFGRWDAIQNAILQDIRKTAPMRKRRESEEDYENRIDKMFKKADSFSIKYINDCIREIAVDDTLFVEDYFATLGAVNTPTIQRENLFLLVQNAFTDVADLLNSEYSAEKSLAQDSVNVSKIKALLDAIKSLQQFVRPLLGNGDENEKDERFYGEFTSLWAELDEVTLLYDMVRNRMTRKPYSQKKIKLNFANPKLLNGWDENKEKDNSCIILRRDGKYYLAVMDKKSKNLLGKPMPSDGECYEKMVYKLLPGAQKMFPKVFFAKSRIDEFKPSEHILNIYSNGTHKKGNKNFNIEDCHDLIDFFKESIRRHKDWNKFGFEFSDTSTYENVNEFYREADEQGYKLSFVNVSVAYIDKLVNEGEMYLFQIYNKDFSEYSKGTPNMHTLYWKALFDDRNLVDMVYKLNGQAELFYRKKSLDSIRPTHPANQPIKNKNKNNKKKESLFEYDLVKDRRYTVDKFMFHVPITMNFKNAGLEKINQQVREYLQQADDTHIIGIDRGERHLLYLVVIDMHGNIKEQFSLNEIVNECSGNTYHTNYHALLDAREEERLNARRSWQTIESIKELKEGYLSQVIHRITQLMVKYHAIVVLEDLSMGFMRGRQKVEKQVYQKFEKMLIDKLNYLVDKKVDVSQPGGLLNAYQLTNKFESFQSSEKQSGFVFYIPAWNTSKIDPVTGFVNLLDTRYQNVEKARAFFSKFDAIRYNKDKDWFEFGVDYDNFNKKAEGTMTKWTLCTQGVRICTFRNAEKNSQWDTQEVDLTTEMKSLFGQSQIDVNGNLKEAICSQSDKTFFMRLLHLLKLMLQMRNSITGTEIDYLVSPVADGNGNFYDSRKCDSTLPKNADANGAYNIARKGLMLLRQMKTADNLTDVKFDMTNRTWLKFAQQKPYKDE

SEQ ID NO: 149 - protein, 1289 aa, unidentified
MGLAYNFTREHYDWWYNESINKNNEEIGWGGYKFPETIGYEKRIESTTLKIRKMKQLSELTGLYSLSKTLRFELKPIGKTLEHIESKGLIAQDEQRAEEYKKVKDIIDRYHKKFITMCLSDFKFEQNSLETYVALAEDTNRDEKAFDEIKKTLRKQIVETFKKGRSYSDLFKKELIQKHLPEFVSDEEEKKMIANFSKFTTYFNGFNENRKNMYSDEDKSTAIAYRLIHENLPMFVNNMKSFSRIADSDVHQHFTEIESSFSEYLGVEHLEEMFQLDYFSETLTQEQIAVYNHIIGGRALEDGTKLKGINEYVNLYNQQHKDSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSAKSFSIEHLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNADKDWFEFAFDYNKFTAKAKDTRTKWTLCTYGTRIRTFRNPERLNQWDNEEVVLTDEFKKAFANADVNIHGNLKEAICSLQDKKYLEPLMHLMKLLLQMRNSITNSEIDYLLSPVADENGTFYDSRVCSASLPKDADANGAYNIARKGLWAIHQIQESPADDRLNLAIKNKDWLNFAQQKPYMNE

SEQ ID NO: 150 - protein, 1276 aa, unidentified
MAAFFFKDFNNQYSLSKTLRFELVPVGNTLQNIEKKGLINKDAERAESYKKLKKTIDEYHKYFIETALKNVKLSGLDDYFELYSQSKENRNEDDFNKVKSDLRKEIAQAFNTGDSQEPYKRLFGKELIKEDLEEWLKTQPEKSELHYDEGFKNFTTYFTGFNENRRNMYSEEEKSTAIAYRLIHENLPKFIDNIKVFNLIKEKHPELDFSPIYTEMEDLIQGAKLEEIFTLDFFDNLLTQNWIEFINYIIGGKTPAKGNKIKGLNEYINLYNQKQKDKKSRVPKFKQLYKQILSDRSSISLKYNAFENDSELLEAIEYFYNSELCEFEIDSNRVNVFDEIRELIENIESYDLNGLYIRNDLGLTNISQRIFGVYSVFKDSMSYYYDHFVDDKYQDKLVQANTEKKLKALTETKRKWNSDFISIGLLQECVDKYVKTLDSEHEISKKHTGSDIIGYFRKHKLKSDETEDNQQDKELFYSVLSQYRGIKGFLNSANNQDVFLIQDKERVHQLKSFLDSILELIHFVKPLHIQEDNVLKKDESFYSQFNPMYDQLNKFIPLYNMVRNHLTKKPYSKEKIKLNFENSTLLDGWDVNKEQDNSAVILRKDNNYYLALMDKDGKRTFKDAPRTEQKNGSYEKMNYKLLPGANKMLPKVFFSKSRIEYFKPSEDILTNYKNDTHKKGASFNINHCHGLIDFFKESLNKHEDWKHFNFKFSPTKTYEDLSGFYREVEHQGYKISFDNISDDYINEMVDEGKIYLFKIHNKDFSPFSKGRPNLHTLYWKALFEEDNIQNIVYKLNGQAEVFFRKRSIQEDHKIVHKAGKPIKAKNPLTPDSENLFDYDIIKDKRYTVDKFQFHVPITLNFKATGGDNINSKVNTFLKNNPDVNIIGLDRGERHLIYLSLIDQQGKIIKQESLNTIINEKRSIETPYHTLLHHKEKDRDKARKSWDTVENIKELKEGYVSQVVHKIAEMMVEHNAIVVMEDLNFGFKRGRFKVEKQVYQKLEKMLIDKLNYLVFKDFDKNHIGGLYKAMQLTSKFESFAKLGKQSGFLFYVPASFTSKIDPVTGFTNFLYPKYENIAKAKDFFERFDYIQYNKQEDYFEFAFDYNNFTTKAEGLKTKWVVCTHGKERYRYNQQTKTSETVDVSAEIKLLLDSNNIDFENGKDIKKSIVLSDSKEVFAKLLHFLSLTLTMRQSKSGTEIDYIISPVKDNNGVFYDSRNAGTSLPKDADANGAYHVALKGLWCLQQIDKAEDFKKMKLAISNKEWLEFVQNRQESKGL

SEQ ID NO: 151 - protein, 1275 aa, unidentified
MAKNFEDFKRLYPLSKTLRFEAKPIGATLDNIVKSGLLDEDEHRAASYVKVKKLIDEYHKVFIDRVLADGCLPLENEGHNNSLTEYYDSYVSKSQNEDAKKVFEENQQNLRSIIAKKLTEDKAYSNLFGTKLIESYKDKADKAKIIDSELIQFINTAESTQLDSMSQDEAKKLVKEFWGFTTYFVGFFDNRKNMYTAEEKSTGIAYRLVNENLPKFIDNMEAFKKAIARPEIQANMGELYSNFSEYLNVESVPEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQNIKHVAPARKHKESEEDYEKRIAGIFKKADSFSISYINDCLNEADPNNAYFVENYFATLGAVDTPTMQRENLFALVQNAYTEMTALLHSDYPTEKKLAQDKANVAKIKALLDAIKSLQHFVKPLLGKGDESDKDERFYGELALLWAELETVTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFNFSDTSTYEDLSGFYREVEQQGYKLSFTRVSVSFIDQLVEEGKMYLFQIYNKDFSEYSKGTPNMHTLYWKALFDERNLADVVYKLNGQAEMFYRKKSIENTHPTHPANHPILNKNKDNKKKESLFGYDLIKDRRYTVDKFMFHVPITMNFKSSGSENINQDVKAYLRHADDMHIIGIDRGERHLLYLVVIDLQGNIKDQFSLNEIVNDYNGNTYHTNYHDLLDVREEERLKARQSWQTIENIKELKEGYLSQVIHKITQLMVRYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISTQTDKAFFTGLLHILKLTLQMRNSITGTETDYLVSPVADENGIFYDSRSCGDQLPENADANGAYNIARKGLMLIEQIKNAEDLNNVKFDISNKAWLNFAQQKPYKNG

SEQ ID NO: 152 - protein, 1275 aa, unidentified
MAKNFEDFKRLYSLSKTLRFEAKPIGATLDNIVKSGLLDEDEHRAASYVKVKKLIDEYHKVFIDRVLANGCLPLKNEGHNNSLTEYYDNYVSKSQNEDAKKTFEENQQNLRSIIAKKLTEDKAYANLFGKNLLESYKDKTDKTKIIDSDLFKFINTAESTQLDSMSQDEAKELVKEFWGFITYFYGFFDNRKNMYTSEDKSTGIAYRLINENLPKFIDNMEAFNTAVTRPEIQANMDELYSNFSEYLNVESIQEMFQLDYYNMLLTQKQIDVYNAIIGGKTDDEHDVKIKGINEYINLYNQKHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQDIKHVAPARKHKESEEDYEKRIAGIFKKADSFSISYINDCLNEADPNNAYFVENYFATLGAVDTPTMQRENLFALVQNAYTEITALLHSDYPTEKNLAQDKANVAKIKALLDAIKSLQHFVKPLLGKGDESDKDERFYGELASLWTELDTVTPLYNMIRNYMTRKPYSQKKIKLNFENPQLLGGWDVNKEKDYATIILRRNGLYYLAIMNKDSKKLLGKAMPSDGECNEKMVYKLLPGANKMLPKVFFAKSRMEDFKPSKELVEKYNNGTHKKGKNFNIQDCHNLIDYFKQSIDKHEDWSKFGFKFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVGYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISTQTDKAFFTGLLHILKLTLQMRNSITGTETDYLVSPVADENGIFYDSRSCGDQLPENADANGAYNIARKGLMLIEQIKNAEDLNNVKFDISNKAWLNFAQQKPYKNG

SEQ ID NO: 153 - protein, 1274 aa, unidentified
MNTTYTNLFALSKTLRFELIPQGKTLHFIQEKGLITNDNKRAESYQKMKKTIDEFHKYFIDLALKNVRLSFLEDYLDLYNQSADYKKEPKFKEELKKVQDNLRKEIVLSFSKDEAKTIFSILDKKELITEELEKWFENQEKKDLHFDDKFKTFTTYFTGFHQNRKNMYSSEPNSTAIAYRLIHENLPKFLENAKAFERIKQVPELQLKIEKIYKDFELYLNVNSIEELFELNYFNDVLTQMGIDVYNNIIGGRTETDGKPKIQGLNEIINLYNQTKSKNERLPKLKQLYKQILSDRVSLSFLPDAFTDGKQVLQAIFAFYKVNILSYTIDGQAESKNLLELIQQLLANISSFETERIHLKNDTNLTTISQQLFGDFSVFSTALNYWYETKVYPKFEAEYTKATEKKRETLEKTKAVFTKQDYFSIAFLQEIITEYSLSLDKDSELITKITPTCVADYFKNHFVAKKENETDKTFGFLANITAKYQCIQGTLENATNYNEELKQDQKLIDDIKLFLDTLLELLHFIKPLHLKSDSITEKDNAFYDLFENYYEALSLLTPLYNMVRNYVTQKPYSTEKIKLNFENAQLLNGWDVNKEADYLTTILKKEGNYFLAIMDKKHNKAFQKFPEGENNYEKMTYKLLPGVNKMLPKVFFSNKNIAYFNPSKELVENYKNETHKKGEKFNLLHCRQLIDFFKDSINKHEDWKHFDFQFSETKSYQDLSGFYREVEHQGYKINFKNIDSAYIDSLVNEGKLFLFQIYNKDFSPFSKGKPNMHTLYWKALFEDQNLKNVKYKLNGQAEIFFRKASIKPENIITHKANQSIKAKNPLTPDAKNTFDYDLIKDKRYTVDKFQFHVPITLNFKATGGSFINQNVLEYLKENPEVKIIGLDRGERHLVYLTLIDQQGNILKQESLNTITDAKIATPYHQLLDIKEKERDFARKNWGTVENIKELKEGYISQVVHKIATMMVEENAIVVMEDLNFGFKRGRFKVEKQIYQKLEKMLIDKLNYLVLKDKQPTELGGLYNALQLTNKFESFQKMGKQSGFLFYVPAWNTSKIDPTTGFVNYFFTKYENVDKAKVFFDKFQSIRYNTKANYFEFEVKKYSDFNPKAEGTLQEWTVCSYGERIETKRLKDQNNNFVSTPINLTEKIEDFLGRNNIVYGDGTCIKSQIAEKNAKEFFEGLLYWFKMTLQMRNSATGTDEDYLISPVMNAQGEFYDSRKADETLPKDADANGAYHIAKKGLMWLEQIKSFDGNDWKKLELDKSNRGWLQYIQQRK

SEQ ID NO: 154 - protein, 1248 aa, unidentified
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVTQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCTELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNTYTDVKEVIGFYSESTDTKLIRDNGSIQKIKLFLDAVKDLQAYVKPLLGNGDETGKDERFYGDLIEYWSLLDLITPLYNMVRNYVTQKPYSVDKIKLNFRNPTLLDGWDLNRETANTSVILRRDGKYYLAIMNNKSRKVFLKYPLGTGKDCYEKMEYKLIPGAYKMLPKAFFAKSKINKFMPDEHLLSNYKKGTHKKNNANFDLDDCHTLIDFFKKSLNKHEDWKNFDFKFSDTSTYTDINNFYKEIDNQAYKLSFRPVPSDFVDKLVEEGKIFLFWIYNKDFSGHSKGTPNMHTLYWRMLFDERNLEDVVYSLNGGAEVFFRKASINVSHPTHPANIPIKKKNLKHKDEERILKYDLIKDKRYTVDQFQFHVPITMNFKADGNGNINQKAIDYLCSASDTHIIGIDRGERNLLYLVVIDGNGKICEQFSLNEIEVEYNGENYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKKWMIT

SEQ ID NO: 155 - protein, 1110 aa, unidentified
MSQDETKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLSDYSLDGIFIRNDLQLTDISQKMFGNWCVIQNAIMQNIKHVAPARKHKESEEDYEKRIAGIFKKVDSFSISFINDCLNEADPNNAYFVENYFATFGAVNTPTMQRENLFALVQNAYTEVAALLHSDYPTAKHLAQDKVNVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSEGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPITGFVNLLDTRYQNVEKAKVFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKDAKDLDNLKFDISNKSWLNFAQQKPYKNE

SEQ ID NO: 156 - protein, 1275 aa, unidentified
MRKFNEFVGLYPISKTLRFELKPIGKTLEHIQRNKLLEYDAVRADDYVKVKKIIDTYHKYLIDEALSGFTFETEADGRRNNSLSEYYWYYNLRKRNEQEQKTFKTIQNNLRKQIVDKLTQSEKYKRIDKKELITTDLPDFLTNESEKELVEKFKNFTTYFTEFHKNRKNMYSKEEKSTAIAFRLINENLPKFVDNIAAFEKVASSPLAEKINALYEDFKEYLNVEKISSVFRLEYYNELLTQKQIDLYNAIVGGRTEEDNRTQIKGLNQYINEYNQQQTDRSNRLPKLKPLYKQILSDRESVSWLPPKFDSDKELLTKIKECYDALSEKEKVFDKLESILKSLSTYDLSKIYISNDSQLSYISQKMFGRWDIIGKAIREDCAKRNPQKNRESLEKFAERIDKKLKAIDSISIGDVDECLAQLGEPYVKRVEDYFAAMGASEIGEEQIGQEFFKKNIEEAYESVKELLNNADNITDNNLMQDKGNVEKIKNLLDAIKDLQRFIKPLLGKGDEADKDGVFYGEFTSLWTKLDTVTPLYNMVRNYLTSKPYSTKKIKLNFENSHFLRGWAKDYNKKAGLIYEKAGLYYLAIVDKKISNDDKKLLHKNVDEDVASRIIFDFQKPDEKNTPRLFIYSKKNPITIAPAVDIYNLPIDSILDVWNKEKYKVEYRQQDQLGYEQALYSLIDYFKEGFSKHESYKHYDFKWKETNKYKDISEFYHDVEISCYEVKYDKVNWKTLLKFVDEGKLYLFQIYNKDFSDHSKGTPNMHTLYWKMLFDEENLKDVVYKLNGEAEVFFRKSSITVQSPTHPANSPIKNKNKDNKKKESKFEYDLIKDRRYTVDKFLLHVPITMNFKSVGGSNINQLVKRYIRSATDLHIIGIDRGERHLLYLTVIDSRGNIKEQFSLNEIVNEYNGNTYRTDYHELLDTREGELTEARRNWQTIQNIRELKEGYLSQVIHKISELAIKYNAVIVLEDLNFGFMRSRQKVEKQVYQKFEKMLIYKLNYLVDKKKPVTETGGLLKAYQLTGEFESFKTLGKQSGILFYVPAWNTSKIDPVTGFVNLFDTHYENIEKAKGFFDKFKSIRYNSDKDWSEFVVDDYTRFSPKAEGTRRDWTICTQGKRIQIYRNPQRNNEWEGREIDLTKAFEEHFEAYGIDISKDLREQINIQNKKEFFEELLRLLRLTLQMRNSMPSSDIDYLISPIADDTGRFFDSRKQAELKGNAVLPMNADANGAYNIARKGLLAIRKMKQEENDSAKISLAISNKEWLKFAQTKPYLED

SEQ ID NO: 157 - protein, 1227 aa, unidentified
MKEQFINCYPLSKTLRFSLIPVGKTEDNFNKKLLLESDKQRAENYENVKSYIDRFHKEYIKSALANARIEKINEYAALYWKNNKDDSDAKAMESLEDDIRKQISKQLTSTANFKRLFGKELICEDLPAFLTDENEKETVECFRSFTTYFNGFNTNRKNMYSSEKKSTAIAYRCVNDNLPRFLDNIKTFQKIFDNLSDETITKLNTDLYNIFGRKIEDIFSVDYFDFVLTQSGIDIYNYMIGGYTCSDGTKIQGLNECINLYNQQVAKNEKSKRLPLMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLESDYEKDYDKRLYKNEKATELVKNLLDAIKEFQQLVKLLNGTGKEENKDELFYGKFTSLYDSVADIDRLYDKVRNYITQRPYSKDKIKLNFDNPQLLGGWDKNKESDYRTVILRKNDFYYLAVMDKSHSKVFVNAPEITSEDEDYYEKMEYKLLPGPNKMLPKVFFASRNIDKFQPSDRILDIRKRESFKKGATFNKSECHEFIDYFKESIKKHDDWSKFGFEFSPTESYNDISEFYREVSDQGYYISFSKISKNYIDKLVENGYLYLFKIYNKDFSKYSKGTPNLHTLYFKMLFDERNLSNVVYKLNGEAEMFYREASINDKEKITHHANQPIKNKNPDNEKKESVFEYDIVKDKRFTKRQFSLHVSVTINFKAHGQEFLNYDVRKAVKYKDDNYVIGIDRGERNLIYISVINSNGEIVEQMSLNEIIGDNGYSVDYQKLLDKKEKERDKARKNWTSVENIKELKEGYISQVVHKICELVVKYDAVIAMEDLNFGFKRGRFPVEKQVYQKFENMLISKLNLLIDKKAEPTENGGLLRAYQLTNKFDGVNKAKQNGIIFYVPAWDTSKIDPVTGFVNLLKPKYTSVSEAKKLFETIDDIKYNTNTDMFEFCIDYGKFPRCNSDFKKTWTVCTNSSRILSFRNEKKNNEWDNKQIVLTDEFKSLFNEFGIDYTSDLKTSILSISNADFYNRLIRLLSLTLQMRNSIIGSTLPEDDYLISPVANDRGEFYDSRNYKGSNAALPCDADANGAYNIARKALWAINVLKDTPDDMLQKAKLSITNAEWLEYTQR

SEQ ID NO: 158 - protein, 1262 aa, unidentified
MSNFNEFTHLYQLSKTLRFELKPIGETLKHFNESGILDQDEHRAESYKKVKKLIDRYHKEFMEEALRDFVFQMDDEGKNNSLSEYFFLYSLGKRTEAQDNDFKDVKKNLREQIAKYFKASPKYKNLFKQELIKEDLCNNMQCNEEEQKLVEEFHNFTTYFTGFHENRKNMYSDEEKSTAIAFRLVHQNLPKFIDNIGVFDRVRNIDEIKAGIENLQKHFETEGLFKQGEKIEDFFTLDYYSRLAVQSRIEIYNAILGGKTTEKGEKIQGLNELINLYNQQHKETHLPKMKALFKQILSDRQAVSWIEESFKSDNEVLSSVNDFYENLKQNEIFERTKELLTSVGSYDLSKVYITNDQQLTSISQQLYGSWAVIENAILAEMQNETPRKKKEDAEKYNERLKKAYSNRSSFSIAYIDQCLEAVFGENRIPVEQHFANLGKAEIETEAECRKIKIPDVFTQIEQTYSAAKTLLYNPYPKGKHLSQSDEDIEKVKNLLDALKRFQHFIKPLTGSGDEAEKDEMFYSDLTELWAEIDQLNSLYNRVRNHLTGKPYSEEKLKLNFENTSLLTGWDKNMERANTAVILRKGKLYYLAIMKKEHNSIFASDNLPDKGECYEKMVYKQIALPLGFGGFARKCFGSATKLGWTYPTNLLNKEGKIIIKDEEAKDVLPELIDCYKDFLNIYEKDGFKYSSYNFKFKPSNQYEKLSQFFAEIQQQGYKITFQNISSDYIDQLVNDGKLYLFQIYNKDFSPSSKGTPNMHTLYWQMLFDERNLNDGVYQLNGQAEVFFRKKSLNYTKPTHPANQAIANKNPFKKKDKSEFTYDLIKDKRFTMDKFLFHVPITINFKSSKTYDIDAKVRQWLQKADDVHIIGIDRGERHLLYLTVIDCKGNIKEQMSLNTIENEYNGNTYAFDYHKRLDEKEKERDAAKKSWKTVENIKELKEGYLSQAIHKITQLMLKYNAIIVLEDLNMGFMRGRQKVEKQVYQKFEKMLIDKLNYLADKKKDPSEMGGVLNAYQLTSKFESFTKLGRQSGFLFYIPAWNTSKIDPVTGFVNLFDTQYKSDDKAKMFFSKFKSISYNKDKNWFEFSFDYNDFTNKAEGTKTQWTVCTNGERIENFRSGQKPNQWGGRTINLSQKFKSLFDEYGIDFTKDLQNAICSQSKKGFFKQLLYLFKLTVQMRNSNTETDYLISPVCDRNGNFYDNGNNNYDNDLPENADANGAYNIARKGLMILNHIKQSSDPSKKQEYNLTNKAWLNFVQKGSVEGK

SEQ ID NO: 159 - protein, 1236 aa, unidentified
METFSGFTNLYPLSKTLRFRLIPVGETLKHFIDSGILEEDQHRAESYVKVKAIIDDYHRAYIENSLSGFELPLESTGKFNSLEEYYLYHNIRNKTEKNQKSLSTVRFNLRKQMVKQLTKNELYKRIYKQNLIKKDLIDFVKNEPDANEKIALISEFRNFTVYFKGFHENRRNMYLDEEKSTSIAFRLIHENLPKFIDNMEVFAKIQNTSISENFDVIQKELCPELVTLCEMFKLGYFNKTLSQKQINAYNTVIGELNKYLNHYNQKHKQEKLPKMKLLFKQILSDRESTSWLPERFANDGQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNTYTDVKEVIGFYSESTDTKLIRDNGSIQKIKLFLDAVKDLQAYVKPLLGNGDETGKDERFYGDLIEYWSLLDLITPLYNMVRNYVTQKPYSVDKIKLNFRNPTLLDGWDLNRETANTSVILRRDGKYYLAIMNNKSRKVFLKYPSGTGKDCYEKMEYKLIPGAYKMLPKAFFSKSKINKFMPDEHLLSNYKKGTHKKNNANFDLDDCHTLIDFFKKSLNKHEDWKNFDFKFSDTSTYTDINNFYKEIDNQAYKLSFRPVPSDFVDKLVEEGKIFLFWIYNKDFSGHSKGTPNMHTLYWRMLFDERNLEDVVYSLNGGAEVFFRKASINVSHPTHPANIPIKKKNLKHKDEERILKYDLIKDKRYTIDQFQFHVPITMNFKVAGNGNININQKAIDYLRSASDTHIIGIDRGERNLLYLVVIDGNGKICEQFSLNEIEVEYNGEKYSTNYHDLLNVKENERKQARQSWQSIANIKDLKEGYLSQVIYKISELIVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGAKTDWTVCSYGNRIITFRNPDKNSQWDNKEINLTENVKLLFERFGIDLSSNLKDEIMERTEKEFFIELISLFKLVLQMRNSWTGTDIDYLVSPVCNENGEFFDSRNVDETLPQNADANGAYNIARKGMILLDKIKKNNGEKKLALSITNREWLSFAQGCCKNG

SEQ ID NO: 160 - protein, 1222 aa, unidentified
MINKFTNMYNLSKTLRFSLIPYWETEEYFMKRHLLDEDKERAKSYVKVKEYMDRYHRYFIEKVLNTVVLNNIDEYSELYFKRNKSDAETKKMEELEATMRKQISKCFRDYSVSGEKIYPLLSKSDLIKKLLPEFLTQEEEKTILAQFNDFSTYFQGFWENRENIYTDKAQNTGIPYRCINDNLPIFLDNVKSFEKIINALPQDDIDELNNTFEGVYNTKGQDAFNVDYFSFVLSQSGIDKYNGIIGGYSNSDDSKVQGINEKVNLYNQQIAKSDKSKRLPFLKQLHKQILSDRETISFIPENFCDDNEVLKSINDFYKNIKPSLEVVNELVSEISNYDTGIIYISAGEPVTNISNKVFGDWSVIRNNWNTEYELTHKKGRDEEKFYEKEREEYKKIKSFSISELQRLANSNESITEYIEDEYKTLFDNIESAYKSAEPLLSNEYQHKKSLAKNDEAVELIKVLLDSIKAYEAFLKQFCGSGKEEEKDNLFYGKFAEPFEEIKKVNLIYNKVRNYITKKPYSNEKLKLNFQNPQFLGGWDKNKEKDYRTVLLKKDGKYFLGVMEKGNNKIFDSFPEDAESSFEKMEYKLLPDPSKMLPKVFFAASNTELFNPSNEILKIREKGSFKKGKTFDLNECHKFIDFYKDCIEKHPDWYKFGFKFTETKDYADISKFFREVSDQGYSIKFRKISEEYLKDLVKDGKLYLFQIYNKDFSEYSKGTPNLHTLYFKMLFDERNLENVVYKLSGGAEMFYRKASIKNEDMVVHQKNQPIENKNPDNVKKESIFDYDITKDKRYTKYQFQLHLPLTLNYKAIGNGFINEDVRVALKQSDSNYVVGIDRGERNLVYACVVDTNGKLVEQIPLNEIKADNGYETDYHKLLDKREKEMDSARKSWKTIGSIKELKEGYISQVVHKICQLVIKYDAVIAMEDLNYGFMNSRKKVEKQVYQKFERMLTQKLNYLVDKKLEPTEMGGLLNAYQLTNEASKVRKGRQDGVIFYIPAWLTSKIDPTTGFVNLLNPKYSSVSASKEFFNKFDEIKYNKDEDYFEFSFNYDNFPKCNSDFKKVWTVCTFGDRIKTFGDPENNNQFNSKSIVLTQEFKSLFDNSGIDYNLNLKEQILSKDDKSFYKALIGLLSLTLQMRNSVSGNGDIDYLISPVKNSKGEFYDSRNYDLTSSLPCDADSNGAYNIARKGLWAVNQIKQAEDETKAKISIKNSEWLQYAQTQND

SEQ ID NO: 161 - protein, 1234 aa, unidentified
MRTIFDDFIGKYGVSKTLSFELLPQGATLEWMEKKELLAEDEHRAESYEKVKQMMDEFHRFFIDDVLGDFRLAGLSEYVSLYEKPDKDEKEKADFEACQENLRKQIANAFKKHPVFSHLFSKDLIREELVNFYKGRKEVAYLQEFLHFTTYFKGFYDNRANIYVAEPISTSIGYRLIHQNLPKFLDNRKVFFQICNSPLHQVFGTLEENLKKYLPKCSVEKMFEIEAFSDYLTQEGIENYNLLLSGYSDEEGNKIQGLNEYIHLYNQKVPKCEQIGKLQPLYKQILSDRQGVSFIPKKFENDHEVVEALFKFYDAFAPVLGVRDNGQKSLMSLALQLEDFNLEHIYVRNDGSLKEISNQLFGDWSFVNKACESWYDQTYSGKKKAGTKAYMEERTKFFKRQDSFSIAFLNMCLSCVGSDVRIESYWTRFCDESGENFAMGIEKRYEAMEAVLRGFDHEEKKLMKSKRGIGVVKEFLDQVKELQWYLKPLLGKGSEGDKDSQFYGEFLPCYEVLQEMTLLYNQVRNYVTQKPYSTEKIKLNFSNAALLNGWSLSKEETNASMIFLKDGLYYLGIMDKGHRKVFSGELPSEGEVYQKMDLQLLPGANKMLPKVFFSKKGLEIYQPSEEILRIYKEGAFKKGANFSLEDCHKLIDFFKDSISIHEEWKHFGFVFSPTEDYEDISGFYREVEAQGYKINFRPVSRSYIDKLIDEGKFYFFQIYNKDFSPYSKGTPNLHTLYWKALFAPENLSDVVYQLNGNAEIFWRKASISEENLITHPANEPVANKNPLNPKKESLFSYTLYKDRRYTMDKFQLHVPITMNFKAKGFGRLNEEVNRCIKGTEDLHVIGINRGERHLLYVSVIDSKGTIVEQYSLNEIVNEYKGVTHRVDYHGLLEAKEQERDIARKNWDTIENIKELKEGYISQVVHKIVQLMVQYQAVIVMEDLNVGFLRGRQAIEKQVYQKFLKMLIDKLNYYVDKKLAPTENGGVLRAYQLTNKFESFQKIGKQNGFLFFAPSWYISNLDPTTGFVNLLYPKYENLPAAKQFFEKFEDIFYDAKEDYFCFSLDYTKFTDKAKETKTDWVLCSYGDRVITFRNKEKNMRWDYESVFPTVLLKDLFSRFGIDYRKNLQEQILAQDEKAFFEELCRILQLILQMRNFNKEADYLISPVRNAAGGFYDSREGKAGLPDNVEANAAYNIARKGLWMLEQIRGTEDEKLGKGMKFALTNQEWLKFAQGL

SEQ ID NO: 162 - protein, 1275 aa, unidentified
MTGLSDFIGCYSLSKTLRFELKPIGRTAEAIVESGILEKDAHRAESYQKVKKLIDRYHKAYIAQCLSYFHFNGEMLDEFYELYSKSQRTDDDVHRMGALQDALRTAVGKALRGEEAYKRIFSKELIREDLPEFLEELDEKNMVEEFREFTTYFTGFHENRKNMYSDDAQHTAIGFRLVHENLPKFIDNMRVFALVAQSPVAEHFPELYKDMESYLNVEEVGEMFNLQYYNMVLTQEQIEVYNGIIGGRTTEEGRKIQGLNEYINLYNQRQKDRKTRLPKFKLLFKQILSDREKLSWLPDMFSDSSQVLEAIEEKYHELHDELMITLKTMFESLEDYDLEHVYIKNDLQLTNLSQRIFGDWNFISQKIEEDYKALMPKKKKETEGDYAERVRQRIKKEGSFSIAYLQRVTACSITDYYADFGACDKDGVQEVNLLQQIENCYAEVKHLLGGGYPKEKDLAQDKDNVEKIKALLDSIKALQHYVKPLLGTQSEAEKDERFYGEFTILWERLDEITPLYNKVRNFATRKPYSQEKIKINFENAQLLGGWDDNKESTNASIILLKDGLYFLGIMDKSSRKILDKDMPDEGECYDKMVYKYFKDITTMVPKCTTQLKDVKSHFQHSGAPYRLFNAETFDSPVYITKEVYELNNVTYEKKKKFQKDYLKITGDALGYAAAVKTWIAFCMQFLKAYKSTAVYDFTEIEQNLHTFTDVSTFYNEVNLLLYKICMKRVSVRFIDKLVEEGKLYLFQIYNKDFSPMSKGTPNMHTLYWTMLFDERNLKDVVYKLNGQAEVFFRKASIEAKHPTHPARKPIDNKNPLSEKRQSVFEYDLVKNRRYTVDKFLFHVPITMNFKGTQSGNVNPLVNDFIRSNPDIHFIGIDRGERHLLYLTVVDGRGQIKEQYSLNQIVNECRGLRYSTDYHRLLEERGGERQKQRKNWDVIENIKELKQGYMSQVVHKIAALVLKYKAVVVLEDLNSGFKRGRQCIEHAVYQQFEKALIEKLNYLVDKKIPADEPGGVLKAYQLTCSTKDFSNMNRQNGFVFYIPAWNTSKIDPVTGFVNLLDTRYENVEKAKAFFGKFKAIRYNDEKKWLEWSLDYADFTNKAEGTRTEWTLCTWGTRVKTFRNPAKNSQWDSQEVNLTEEFLKLFSKAGIKTSGNLKEAICSFNGAGYNGQPVTEKDFYESLLALLKLTLQMRNSVTGTEIDYLVSPVADADGKFFDSRTCGALLPENADANGAYNIARKGMWVAEQIRNNPDGKQRPTITNREWLAYAQEKPYLR

SEQ ID NO: 163 - protein, 1245 aa, unidentified
MQERKKISHLTHRNSVQKTIRMQLNPVGKTMDYFQAKQILENDEKLKENYQKIKEIADRFYRNLNEDVLSKTGLDKLKDYADIYYHCNTDADRKRLNECASELRKEIVKNFKNRDEYNKLFNKKMIEIVLPEHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDKIREKSIVDYYKTSLMQLTDNLSDKYKEAAPLLNESYANEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNRILENIDFQNCDESDCYEKIIYKLLPGPNKMLPKVFFSEKCKKLLSPSDEILKIRKNGTFKKGDKFSLDDCHKLIDFYKESFKKYPNWLIYNFKFKKTNEYNDISEFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKHTPIKNKNTLNDKKASTFPYDLIKDKRYTKWQFSLHFPITMNFKAPDRAMINDDVRNLLKSCNNNFIIGIDRGERNLLYVSVIDSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDEIRYNAGEDFFEFDIDYDKFPKTASDYCKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKSDNVSTVEPVIHNDKWLKFVQENDMANN

SEQ ID NO: 164 - protein, 1245 aa, unidentified
MQEHKKISHLTHRNSVQKTIRMQLNPVGKTMDYFQAKQILENDEKLKEDYQKIKEIADRFYRNLNEDVLSKTGLDKLKDYAEIYYHCNTDADRKRLDECASELRKEIVKNFKNRDEYNKLFNKKMIEIVLPQHLKNEDEKEVVASFKNFTTYFTGFFTNRKNMYSDGEESTAIAYRCINENLPKHLDNVKAFEKAISKLSKNAVDDLDTTYSGLCGTNLYDVFTVDYFNFLLPQSGITEYNKIIGGYTTSDGTKVKGINEYINLYNQQVSKRYKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFNESYANEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIRKNGTFKKGDKFSLDDCHKLIDFYKESFKKYPNWLIYNFKFKKTNEYNDISEFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKRASTFPYDLIKDKRYTKWQFSLHFPITMNFKAPDRAMINDDVRNLLKSCNNNFIIGIDRGERNLLYVSVIDSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLDSFDKLGMQSGFIFYVRPDFTSKIDPVTGFVNLLYPRYENIDKAKDMISRFDEIRYNACEDFFEFDIDYDKFPKTASDYRKKWTICTNGERIETFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKSDNVSTVEPVIHNDKWLKFVQENDMANN

SEQ ID NO: 165 - protein, 1319 aa, unidentified
MAKNFEDFKRLYSLSKTLRFEAKPIGATLDNIVKSGLLDEDEHRAASYVKVKKLIDEYHKVFIDRVLDDGCLPLENKGNNNSLAEYYESYVSKAQDEDAKKKFKEIQQNLRSVIAKKLTEDKAYANLFGNKLIESYKDKEDKKKIIDSDLIQFINTAESTQLNSMSQDEAKELVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDNKLPKFKALFKQILSDRNAISWLPEEFNSDQEVLNAIKDCYERLSENVLGDKVLKSLLGSLSDYTLDGIFIRNDLQLTDISQKMFGNWCVIQNAIMQNIKHVAPARKHKESEEDYEKRIAGIFKKADSFSISYINDCLNEADSNNAYFVENYFATFGAVNTPTMQRENLFSLVQNAYTEVAALLHSDYPTAKHLAQDKANVAKIKALLDAIKSLQHFVKPLLGKGDESDKDERFYGELASLWAELDMVTPLYNMIRNYMTRKPYSQKKIKLNFENPQLLGGWDANKEKDYATIILRRDGLYYLAIMGKDSKNLLGKAMPSDGECYEKMVYKQFDISKQLPKCTTELKHVRKALVEDAKRSCLLSDFNNWNKPLNVTRKLWELNNFVWDKKKEDWVLRKKDNETRPKKFHKKYLELTSDKKGYNQAKNDWIKFTKEFLSSYKKVEAYDIHYKKRYNSVDELYKQLNGDLYAISFTYVSVSFIEQLVSEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQFSLNEIVNDYNGNTYHTNYHDLLDVREEERLKARQSWQTIENIKELKEGYLSQVIHKITQLMVKYHAIVVLEDLNMGFMRGRQKVEKQVYQKFEKMLIEKLNYLVDKKADASVSGGLLNAYQLTSKFDSFQKLGKQSGFLFYIPAWNTSKIDPVTGFVNLLDTRYQNVEKAKAFFSKFDAIRYNKDKEWFEFNLDYDRFGKKAEGTRTKWTLCTRGMRIDTFRNKEKNSQWDNQEVDLTTEMKSLLEHYYIDIHGNLKDAISMQTDKAFFTGLLHILKLTLQMRNSITGTETDYLVSPVADENGIFYDSRSCGDQLPENADANGAYNIARKGLMLVEQIKDAEDLDNVKFDISNKAWLNFAQQKPYKNG

SEQ ID NO: 166 - protein, 1245 aa, unidentified
MQEHKKISHLTHRNSVQKTIRMQLNPVGKTMDYFQAKQILENDEKLKENYQKIKEIADRFYRNLNEDVLSKTRLDKLKDYAEIYYHCNTDTDRKRLNECASELRKEIVKNFKNRDEYNKLFNKKMIEIVLPKHLKNEDEKEVVASFKNFTTYFTGFFTNRKNMYSDGEESTAIAYRCINENLPKHLDNVKAFEKAISKLSKNAVDDLDATYSGLCGTNLYDVFTVDYFNFLLPQSGITEYNKIIGGYTTSDGTKVKGINEYINLYNQQVSKRDKIPNVKILYKQILSESEKVSFIPPKFEDDNELLSAVSEFYANDETFDGMTLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENNEIREKSIVDYYKTSLMQLTDNLSDKYKEAAPLFSENYDNEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIRKNGTFKKGDKFSLDDCHKLIDFYKESFKKYPNWLIYNFKFKKTNEYNDISEFYNDVALQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKKASTFPYDLIKDKRYTKWQFSLHFPITMNFKAPDKAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVIKYDAIIVMEKLTDGFKRGRTKFEKQVYQKFEKMLIDKLNYYVDKKLDPDKEGGLLHAYQLTNKLESFDKLGTQSGFIFYVRPDFTSKIDPVTGFVNLLYPRYENIDKAKDMISRFDDIRYNAGEDFFEFDIDYDKFPKTASDYRKKWTICTNGERIEAFRNPTSNNEWSYRTIILAEKFKELFDNNSINYRDSDDLKAEIFSQTKGKFFEDFFKLLRLTLQMRNSNPETGEDRILSPVKDKNGNFYDSSKYDEKSKLPCDADANGAYNIARKGLWIVEQFKKSDNVSTVEPVIHNDKWLKFVQENDMANN

SEQ ID NO: 167 - protein, 1245 aa, unidentified
MQERKKISHLTHRNSVQKTIRMQLNPVGKTMDYFQAKQILENDEKLKENYQKIKEIADRFYRNLNEDVLSKTGLDKLKYYTDIYYHCNTNADRKRLNECASELRKEIVKNFKNRDEYNKLFNKKMIEIVLPQHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYNEAAPLLNENYSNEKGLKNDDKSISLIKNFLDTIKEIEKFIKPLSETNITGEKNDLFYSQFTPLLDNISRIDILYDKVRNYVTQKPFSTDKIKLNFGNYQLLNGWDKDKEREYGAVLLCKDEKYYLAIIDKSNNSILENIDFQDCDESDCYEKIIYKLLPGPNKMLPKVFFSEKCKKLLSPSDEILKIRKNGTFKKGDKFSLDDCHKLIDFYKESFKKYPNWLIYNFKFKKTNEYNDISEFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKKASTFPYDLIKDKRYTKWQFSLHFPITMNFKAPDKAMINDDVRNLLKSCNNNFIIGIDRGERNLLYVSVIDSNGAIIYQHSLNIIGNKFKGKTYETNYREKLATREKERTEQRRNWKAIESIKELKEGYISQAMHVICQLVVKYDAIIVMEKLTDGFKRGRTKFEKQVYQKFEKMLIDKLNYYVDKKLDPDEEGGLFHAYQLTNKLESFDKLGTQSGFIFYVRPDFTSKIDPVTGFVNLLYPRYENIDKAKDMISRFDEIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSAVEPVIHNDKWLKFVQENDMANN

SEQ ID NO: 168 - protein, 1245 aa, unidentified
MQEHKKISHLTHRNSVQKTIRMQLNPVGKTMDYFQAKQILENDEKLKEDYQKIKEIADRFYRNLNEDVLSKTGLDKLKDYAEIYYHCNTNADRKRLDECASELRKEIVKNFKNRDEYNKLFNKKMIEIVLPKHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLLAVSEFYANDETFDGMPLKKAIDETKLLFGNLDNSSLNGIYIQNDRSVTNLSNSMFGSWSVIEDLWNKNYDSVNSNSRIKDIQNREDKRKKAYKAEKKLSLSFLQVLISNSENDEIREKSIVDYYKTSLMQLTDNLSDKYKEAAPLLNENYSNEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKELLSPSDEILKIRKNGTFKKGDKFSLDDYHKLIDFYKESFKKYPNWLIYNFKFKNTNEYNDIREFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKKASTFPYDLIKDKRYTKWQFSLHFPITMNFKAPDKAMINDDVRNLLKSCNNNFIIGIDRGERNLLYVSVIDSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDDIRYNAGEDFFEMDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDKWLKFVQANDMANN

SEQ ID NO: 169 - protein, 1246 aa, unidentified
MQERKKISHLTHRNSVQKTIRMQLNPVGKTMDYFQAKQILENDEKLKEDYQKIKEIADRFYRNLNEDVLSKTRLDKLKDYAEIYYHCNTDADRKRLNECASELRKEIVKNFKNRDEYNKLFNNKKMIEIVLPKHLKNDDEKEVVASFKNFTTYFTGFFTNRKNMYSDGEESTAIAYRCINENLPKHLDNVKAFEKAISKLSKNAVDDLDATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKYEDKRKKAYKAEKKLSLSFLQVLISNSENDEIREKSIVDYYKTSLMQLTDNLSDKYNGAAPLLNENYSNEKGLKNDDKSISLIKNFLDAIKEIEKFIKPLSETNIKGEKNDLFYSQFTPLLDNISRIDILYDKVRNYVTQKPFLTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIRKNGTFKKGDKFSLDDCHKLIDFYKESFKKYPNWLIYNFKFKNTNEYNDISEFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKKASTFPYDLIKDKRYTKWQFSLHFPITMNFKAPDKAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPNEEGGLLHAYQLTNKLDSFDKLGMQSGFIFYVRPDFTSKIDPVTGFVNLLYPRYENIDKAKDMISRFDEIRYNACEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKSDNVSTVEPVIHNDKWLKFVQENDMANN

SEQ ID NO: 170 - protein, 1246 aa, unidentified
MQEHKKISHLTHRNSVQKTIRMQLNPVGKTMDYFQAKQILENDEKLKEDYQKIKEIADRFFRNLNEDVLSKTGLDKLKDYAEIYYHCNTDADRKRLNECASELRKEIVKNFKNRDEYNKLFDNKKMIEIVLPKHLKNDDEKEVVASFKNFTTYFTGFFTNRKNMYSDGEESTAIAYRCINENLPKHLDNVKVFEKAISKLSKNAIDDLDATYSGLCGTNLYDVFTVDYFDFLLSQSGITEYNKIIGGYTTSDGTKIKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSSSRIKDIQKREDKRKKAYKAEKKLSLSFLQVLISNSENNEIREKSIVDYYKTSLMQLTDNLSDKYKEAAPLFNENYSNEKGLKNDDKSISLIKNFLDAIKEIEKFIKPLYETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIRKNGTFKKGDKFSLDDCHKLIDFYKESFKKYPNWLIYNFKFKNTTEYNDISEFYNDVALQGYNISKMKIPTSFIDKLVDEGKIYLFQLYNKDFSPHSKGTPNLHTLYFKMLFDERNLEDVVYRLNGEAEMFYRPASIKYDKPTHPKNTPIKNKNTLNDKKASTFPYDLIKDKRYTKWQFSLHFPITMNFKAPDRAMINDDVRNLLKSCNNNFIIGIDRGERNLLYVSVIDSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGMQSGFIFYVRPDFTSKIDPVTGFVNLLYPRYENIDKAKDMISRFDDIRYNAGEDFFEFDIDYDKFPKTASDYRKKWTICTNGERIEAFRNPASNNEWSYRTIILAEKFKELFDNNSINYRDSDNLKAEILSQTKGKFFEDFFKLLRLTLQMRNSNPETGEDRILSPVKDKNGNFYDSSKYDEKSNLPCDADANGAYNIARKGLWIVEQFKKSDNVSTVEPVIHNDKWLKFVQENDMANN

SEQ ID NO: 171 - protein, 1298 aa, unidentified
MNFSDFKRVYPLSKTLRFEARPIGATLDNIIKSGLLDEDEHRAKSYVKVKKLIDEYHKVFIDRVLNEGCLPFENNGERNSLEEYYECYTSKSNDEEAKKTFMIIQQNLRYMIAKKLTDDKAYANLFGKNLIEPYKDKDDKKKIIDSDLIQFINEADSNQLDSMSQDEAKNLVKEFNSFTTYFVGFFDNRKNMYTPEEKQTGIAYRLVNENLPKFVDNMEAFKKAVAKPEIQANMEELYSNFAEYLNVENIKEIFRLDYYNKLLTQKQIDVYNAIIGGKTDDNHDVKIKGINEYINLYNQQHKDEKLPKLKTLFKQILSDRNAISWLPEEFCDDQQVLNAIKDCYERLIENVLGDKVLKSLLSSLADYSLDGIFLRNDTQLTDISQKMFGNWSVIQDAIMQKPARKRKETEEDYDKRISAIFKKADSFSIQYIDDCLNEMGNNNSYTVESYFATLGAVDTPTMQRENLFALIQNAYTDVADLLNSGYPADKKLSQDDNNVAKIKALLEAIMSLLHFVKPLLGKGDESDKDERFYGELASLWTELDTVTPLYNMVRNYISRKPYSEKKIKLNFENPQLLGGWDANKEKDYATIILRRNGLFYLAIMNKDSKKLLGKTMPSNGECYEKMVYKFFKDVTTMIPKCSTQLKDVQAYFKVNTDDFVLNSKAFSKPLTITKEVFDLNNVLYGKFKKFQKGYLSATGDNAGYIRAVNVWIKFCMDFLDSYESTCMYDFSSLKSESYLSLDAFYQDANLLLYKLSFTNVSVSFINKLVDEGKMYLFQIYNKDFSDYSKGTPNMHTLYWKALFDERNLADVVYKLNGKAEMFYRKKSIDYTHPTHPANHPIQNKNKENKKKESVFEYDLIKDRRYTVDKFMFHVPITMNFKSVGSKNINQQVREYLQQADDTHIIGIDRGERHLLYLVVIDMQGNIKEQFTLNEIVNEYNGNTYRTNYHDLLDAREEERLKARQSWKTIENIKELKEGYLSQVVHKITQLMVKYHAIVVLEDLNMGFMRGRQKVEKQVYQKFEKMLIDKLNYLVDKNADVTQSGGLLNAYQLTSKFDRFQKLGKQSGFLFYIPAWNTSKIDPVTGFVNLLDTRYQNSEKAKAFFSKFDAIRYNADKDWFEFILDYDKFGTKAEGTRTRWTLCTQGNRICTFRNPEKNSQWDSQEVDLTKEMKSFFAHYHIDITGNLKEAICSQMEKPFFVGLLHLLKLTLQMRNSITGTETDYLVSPVADENGVFFDSRSCGDTLPENADANGAYNIARKGLMLIGQIKETKDLANFKYDISNKAWLHFAQQKPYKNE

SEQ ID NO: 172 - protein, 1316 aa, unidentified
MKFDDFKKLYSLSKTLRFEAKPVGSTLKNIIESGLLEEDEHRAQSYVKVKKLIDEYHKVFIDRVLNDGCLTIENKGKKDSLEEYYESYMSKSNDENVSKTFKEIQENLRSVIAKKLTDDNAYANLFGNKLIESYKDKDEKNKIIDSDLIQFINTAEPSQLDSMSQDEAKELVKEFWGFTTYFVGFFDNRKNMYTSEEKSTGIAYRLVNENLPKFIDNMEAFKKAIAKPEIQANMEELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQEVLNAINDCYKRLSENVLGDKVLKSLLCSLDDYNLDGIFVRNDLQLTDISQKMFGNWSVIQSAIMQNIKNVTPARKRKESEEDYEKRISDIFKKADSFSIQYINDCLNEMDNNNLHAVDGYFATLGAVNTPTMQRENLFALIQNAYTDISNLLETPYPENKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLVIMDKDSKKLLGKTMPSDGECYEKMVYKQFDISKQLPKCTTELKRVRKALVEDAKRSCLLSDSKDWNKPLNVTRKLWELNNYVWDKKKADWVLRKKENETRPKKFHKKYLELTSDKKGYNQAKNDWIKFTKEFLSSYKKVEAYDIHYKKRYNSVDELYKQLNGDFYTISFSYVSVSFIEKLVDEGKMYLFQIYNKDFSDYSKGTPNMHTLYWKALFDERNLADVVYKLNGQAEMFYRKKSINNTPPTHPANHPIQNKNKDNKKKESVFEYDLIKDRRYTVDKFLFHVPITMNFKSVGSENINQQVREYLQQADDTHIIGIDRGERHLLYLVVIDMQGEIKKQFTLNEIVNEYNGNTYRTNYHDLLDTREEERLKARQSWQTIEDIKELKEGYLSQVIHKITQLMVKYHAVVVLEDLNKGFIRGRQKVEKQVYQKFEKMLIDKLNYLVDKKADAVQSGGLLNAYQLTSKFDSFQKLGKQSGFLFYIPAWNTSKIDPVTGFVNLLDTRQNTEKAKAFFSKFDVIRYNANKDWFEFNLDYDKFCTKAEGTRTRWTLCTQGSRISTFRNADKNSQWDNQKVDLTREMKSLFNYYHINICGNLKEEICSQTDKAFFTGLLHMLKLTLQMRNSITGTETDYLVSPVADENGVFYDSRSCGDTLPKNADANGAYNIARKGLMLIRQIKETKDLANFKYDISNKAWLNFAQQKPYKNE

SEQ ID NO: 173 - protein, 1261 aa, unidentified
MKQKKSQNPFNQFTGLYPLSKTLRFELRPIGKTKENIISAGILAEDNHRAESYKKVKKIIDEYHKAFIERVLKNLDLDKGALQAFYECYKKSTKEEKREETLQEIGNNLRSQISNAFKKDPKYSTLTSKDLINKELPSIATTEEERILLEEFHGFSTYFVGFHQNRENMYSKEEKATSIAYRLINENLPKFIDNIRSFEKIANSPIADKLESIYNEYAKEGYMNVNNLNEMFEISFYNRVLTQTQIDLYNAIIGGKTEKDGRKTQGINEYINLYNQRGEVQKKDRLPLLKPLFKQILSDREHISWFEEGFADDQAMLSAIKDFYLKLTETEPTTTESILDRTRSLLRNIADYDLTKIYLEYTSLSKISQQIFGEWDRIQRALEAEYDATHLQRKKTKTYEEQKEQYFRSLKSVSIGFIDECLNSFETEKQLSLSIKEYIAQVGKKNDDPDLIEHITASYKAVKAILTTEWPKERNVAQEKDIVALIKKLLDRIKDLQYFIKPLLGSGKESDKDNLFYGELASIWEVINTVTPLYDKVRNRMTRKPYSTEKIKVNFRNSHFLSYWPQDYETKGGILFEKEGLYYLAIIDKKLKAKDIERLHCTKSNAVRIIVDTQKPDNKNTPRLFIRSKGENYAPAIDEYKLPIHEIIDLYDRKLFKKPLKGASPEDTEIFKASLTKLIDYFKLGFSRHESYRHYKFNWKKSDEYNDIDEFYQDTIESCYQIIRQPIDWDVVEEYTKEGKIYLFQIYNKDFSSHSKGTPNMHTLYWKTLFDEQNLANVVYKLNGEAEIFFREASLERKVTHPANEPIKTKNPETSIREKTFAYDLIKDKRYTEDKFQLHVPITMNFKGLNVKNINSRVNNYIKTEEDLHFIGIDRGERNLLYVCVIDSKGNIKEQYSLNEIVTQYNRTDYKYLLEKREEEREKERRSWQTIENIKDLKQGYLSQVVHKIAQLMVQYHAIVVLEDLNSGFKRSRQKVEKSVYQQFEKSLIDKLNYLVDKQLPIDEEGGVLRAYQLTNKFESFKTMKMQNGFLFYIPAWNTSKMDPTTGFVNLFDTRYTNINKSKEFFEKFEAIRYNEEKDWFELEFDYKNFTAKAEGTQTQWTLCTWGERINTFRNKSKNSSWDYKTINLTEEYKALFEQFSINYRGNLKKEILEQTSKDFFERLLSLLRLTLQMRNSIPNTDTDYLISPVADANGCFYYSEQCGDNLPKNADANGAYNIARKGMWMAEQIRRSNEGDELNLAISNKEWLRFVQEKPYLEEK

SEQ ID NO: 174 - protein, 1286 aa, unidentified
MKQKKTQNPFNQFIGLYPLSKTLRFELRPYNEKTKNNIISAGILAEDNHRAESYKKVKKIIDEYHKAFIERVLKDLVLEEKPLQAFYECYKKSSKEEALQEIGNNLRTQISNAFEKDPKYSTLTSKDLINKELPSIVTTEEERTLLEEFHGFSTYFVGFHQNRENMYSDEEKATSIAYRLINENLPKFIDNIRSFQKIADSPIADKLESIYDEYAKEGYMNVNTLNEMFEISFYNRVLTQTQIDLYNAIIGGKTEKDGHKTQGINEYINLYNQRGEVQKKDRLPLLKPLFKQILSDREHISWFEEGFADDQAMLNAIKDFYLELTETGPTTTESILDRTKSLLRTIADYDLTKIYLGYNSLSKISQQIFGEWDRIQRALEAEYDQREKTKTYEEKEKHFKSLKSVSIGFIDDCLKAFETDKQLSLSIKEYIAQLGKKNDDPDLIDRITASYKAVKAILTTEWPKERNIAQEKDIVALIKDLLDRIKDLQSFIKPLLGSGKESDKDNLFYGELASIWETINTVTPLYDKVRNRMTRKPYSTQKFKVNFRNSQLLKGWDLNKEKDYMGIILRKKDLYFLAIMNKKNTKVFSSKVPSQGECFEKMIYKQFDATKQVPKCSTELKRVKEAIEIDDKPYYELFDKQKFSKPLTITREIWQLNNLVWDKKTNSFVRRKKDETRPKKFQQEYLDITEDREGYCEALRKWIDFVKDFLASYKSTSIYNIKYKDSSEYASIKEFYNFLDQELYHIEFSNVSVDYINELIEEGKIYLFQIYNKDFSPHSKGTPNMHTLYWKTLFDERNLANVAYKLNGEAEIFFRKASLERKVTHPAHDLIKTKNPKTSIKEKAFAYDLIKDKRYTEDKFQLHVPITMNFKSPMEKKGINSRVNNYIKTAEDLHFIGIDRGERNLLYVCVIDSQGNIKDQYSLNEIVNQYNRTDYKYLLEKREEERDKERKSWQTIENIKDLKQGYLSQVVHKIAQLMVQYHAIVVLEDLNSGFKRSRQKVEKSVYQQFEKSLIDKLNYLIDKRLPIDEEGGVLRAYQLTNKFESFKTMKMQNGFLFYIPAWNTSKMDPTTGFVNLFDTRYTNIDKSKEFFDKFEAIRYNEGKDWFELEFDYEHFTTKAEGTQTQWTLCTWGERINTFRNKSKNSSWDYKKINLTEEYKTLFEQFSINYRGNLKKEILEQNSKDFFERLLSLLHLTLQMRNSIPNTDTDYLISPVADANGHFYYSEQCGDNLPKNADANGAYNIARKGMWMAEQIRRSNEGEELKLAISNKEWLRFAQEKPYLQDK

SEQ ID NO: 175 - protein, 1246 aa, unidentified
MQEHKKISHLTHRNSVQKTIRMQLNPVGKTMDYFQAKQILENDEKLKEDYQKIKEIADRFYRNLNEDVLSKTRLDKLKDYAEIYYHCNTDADRKRLNECASELRKEIVKNFKNRDEYNKLFDNKKMIEIVLPKHLKNDDEKEVVASFKNFTTYFKGFFTNRKNMYSDGEESTAIAYRCINENLPKHLDNVKVFEKAISKLSKNAIDDLDATYSGLCGTNLYDVFTVDYFDFLLSQSGITEYNKIIGGYTTSDGTKIKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIRKKSIVDYYKTSLMQLTDNLSDKYKEAAPMFSENYDNEKGLKNDDKSISLIKNFLDAIKEIEKFIKPLSETNITGEKNDLFYSQFTPLLDNISRIDILYDKVRNYVTQKPFSTDKIKLNFGNSQLLNGWDKDKEREYGAVLLCKDEKYYLAIIDKSNNSILENIDFQDCNESDYYEKIVYKLLTKISGNLPRVFFSEKHKELLSPSDEILKIYKNGTFKKGDKFSLDDCHKLIDFYKESFKKYPNWLIYNFKFKKTNEYNDISEFYNDVALQGYNISKMKIPTSFIDKLVDEGKIYLFQLYNKDFSPHSKGTPNLHTLYFKMLFDERNLEDVVYRLNGEAEMFYRPASIKYDKPTHPKNTPIKNKNTLNDKKASTFPYDLIKDKRYTKWQFSLHLSITMNFKAPDKAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYEKTDKAKDMISRFDDIRYNAGEDFFEFDIDYDKFPKTASDYRKKWTICTNGERIEAFRNPASNNEWSYRTIILAEKFKELFDNNSINYRDSDDLKAEILSQTRGKFFEDFFKLLRLTLQMRNSNPETGEDRILSPVKDKNGNFYDSSKCDEKSKLPCDADANGAYNIARKGLWIVEQFKKADNVSAVEPVIHNDKWLKFVQENDMANN

SEQ ID NO: 176 - protein, 1274 aa, unidentified
MKTQQNFSNLYQLSKTLRFELIPQGKTLEYIQKNGLLENDQQRAESYKVVKKIIDEYHKDFIEKALNGLCLQYENVNSQNSLEEYYHYYSIKQKADNEKKTFVKIQENLRKQIVQRFEKDDACKEQFKRLFAKELIKEDLKSYVTTEEELKVVSEFENFTTYFTGFHENRKNMYKAEEISTAIPYRLIHENLPKFIDNISSFEKVKNTSVAEKFAKLYEDFEMYLNVSCIEDIFTLQSYTDFLSQSQIDVYNAVIGGKTLKDKTKIQGLNEYINLYNQQQTDKHNRLPKLKPLFKQILSDRNAISWLAEEFEPGNDTKVLQSIYQCYEDIALNCLLKEVEGEMSLVDLLLHIQDFELDKIYIKNDTSLTEISQKIYGDWAIIQKSVEKVFEQNNPKKKNETEESYQERKSKFFKSFDSFSIQYLNTCIELYNTEVLHEATLSPIQSYFNSLGVFNVNDELTKNLFVAIQDAYSNAEELLRNDYPADKDLAQQKDDVAKIKVLLDSIKALQWFIKPLLGKGNEAEKDGKFYGEFDKLWQTLDQVTPLYNKVRNYMTRKPYSVEKIKLNFENSYFLSGWAPDYETKAGLLYERNGNYYLGINNKKLSLDEKNYLKGTGAKRIILDFQKPDNKNIPRLFIRSKGENFAPAVNKYSLPINDIIDIYDNGKFKTEYRKVNENDYKKSLHKLIDYYKIGFTKHESYKHYTFSWKTTTEYKDIAEFYNDVETSCYQVHEENVNWERLLNYVEEGKLYLFQIYNKDFSPHSKGTPNMHTLYWRMLFDAENLKDVIYKLNGQAEVFYRKSSIKPENIIVHKAQEAIANKNLKNNKQQSIFEYDIIKDKRFTIDKFQFHVPITMNFKGIGLQNINSQTNQYIQENHSDIHVIGIDRGERHLLYLTLINSRGEIVKQFSLNEIVNEYNGKTYATNYHDLLDAREKARLHERESWKTIETIKELKEGYISQVIHKITELMVQYNAIVVLEDLNMGFMRGRQKVEKQVYQKFEKMLIDKLNYLVDKKKAPTEPGGVLNALQLTNKFESFQKMGKQSGFLFYVPAWNTSKMDPVTGFVNLFDTRYERIDKAQDFFKKFKTIKYNESKQYFEFHVDDYAKFSGRAEGTRQNWILCTYGQRIITYRNPEKNSQWDSKEVDLTQEFIQFFTSKSIDYTATDIQNIITKQTEKEFFEKLLNLFKLTLQMRNSITGTETDYLISPVTHAAGEFYDSRKAIDSLPKDADANGAYNIARKGLWVIEQLKQAPDLAKVKLAISNKEWLGSVQNNKK

SEQ ID NO: 177 - protein, 1319 aa, unidentified
MEFDDFKRLYPLSKTLRFEAKPIGATLKNIIKSGLLEEDEHRAQSYVKVKKLIDEYHKVFIDRVLNEGCLTIESKGGQDSLEEYFESYISKSNDENANKAFKKIQKNLRSVIANKLTKDKGYANLFGKNLIESYKDKEEKNKIIDSDLIQFINTVEPSKLDSMSQDEAKKLVKEFSGFTTYFKGFHKNRKNMYTSEEKSTGIAYRLINENLPKFIDNMEAFKKAIAKPEIQANIEELYSNFAGYLNVESIQEMFQLDYYNMLLTQKQIDVYNAIIGGKTDEENDVNIKGINQYINIYNQHHKDEKLPKLKALFKQILSDRNAISWLPEEFNSDQEVLDAIKDCYERLSENVLGDKVLKSLLCSLSDYNLNGIFVRNDTQLTDISQKMFGNWSVIQNAIMQNIKKKKLARKRKESEEDYEKRIPDIFKKADSFSIQYINDCLNEMDNNNLHAVDGYFATLGAVNTPTMQRENLFALIQNAYTDISDLLDTPYPENKNLAQDKTNVAKVKALLDAIKSLQHFVKPLLGLGDESDKDERFYGELASLWTELDTVTPLYNMVRNYMTRKPYSQKKIKLNFENYQLLEGWDANKEKDHAAIILRRNGMYYLAIMDKDSKNLLGKTMLSDGECYEKMVYKQFDISKQLPKCTTELKRVRKALVEDAKRSCLLSDSKDWNKPLNVTRKLWELNNYVWDKKKADWVLGKKENETRPKKFHKKYLELTSDKKGYNQAKNVWIKFTKEFLSSYKKVEDYDIHYKKRYNSVDELYKQLIGDFYTISFTYVSVSFIDKLVDEGKMYLFQIYNKDFSDFSKGTPNMHTLYWKALFDERNLADVVYKLNGEAEMFYRKKSINNTHPTHPANHPIQNKNKENKKKESVFEYDLVKDYRYTEDKFLFHVPITMNFTSVGSENINQQVKEYLQQADDTHIIGIDRGERHLLYLVVIDMQGNIKEQFSLNEIVNEYNGNTYRTNYHDLLDVRADKRLKASQSWQTIENIKELKEGYLSQAIHKITQLMVKYHAVVVLEDLNKGFMRSRQKKEKQVYQKFEKMLIDKLNYLVDKHKDANETGGLLHALQLTSGFKNFKKSDPQSGFLFYIPAWNTSKIDPVTGFVNLFDTRYTNAEKALEFFSKFDAIRYNEEKDWFEFEFDYDKFTQKAHGTRTKWTLCTYGMRLRSFKNPAKQYNWDSVVVALTDEFKRILEEVGIDIHENLKDAICNLEGKRRKYLEPLMQFMKLLLQLRNSRKNPEEDYILSPVADENGVFYDSRSCGDQLPENADANGAYNIARKGLMLIREIKKAKELDKLKFDISNKAWLNFAQQKPYKNE

SEQ ID NO: 178 - protein, 1261 aa, unidentified
MKQKKTQNPLNQFIGLYPLSKTLRFELHPIGKTRENITSVGILAEDNHRAESYKEVKKIIDEYHKAFIERVLKDLVLEEEPLQAFYECYKKSSKEEKREKALQDNGKKLRYQISKAFEKDPKYKTLTGEDLINKELPRIVTTDEEQMLLKEFRGFTTYFKGLHLNRKNMYSNEEKASSIAYRLINENLPKFIDNIRSFQKIADSPIADKLESIYDEYAKEGYMNVNTLNEMFEISFYNRVLTQTQIDLYNAIIGGKTEKDGHKTQGINEYINLYNQRGEVQKKDRLPLLKPLFKQILSDREHISWFEEGFADDQAMLNAIKDFYLKLTKTGPTTTESILDRTRSLLRNIADYDLTKIYLEYTSLSKISQQIFGEWDRIKRALEVEYDATHLQRKKTKNYEKKKEQYFESLKSVSIGFIDDCLKAFETDKQLSLSIKEYIAQVGKKNDDPDLIERITASYKAVKAILTTEWPKERNIAQEKDIVALIKDLLDRIKDLQSFIKPLLGSGKESDKDNLFYGELASIWEVINIVTPLYDKVRNRMTRKPYSTQKFKVNFSNSHFLSYWPQDYETKGGVLFEKEGLYYLAIIGKKLKTKDIEKLHCTKSNAFRIIIDTQKPDNKNTPRLFIRSKGENYAPAVDEYKLPIHEIIDLYDRKLFKKPPKEASLEDTEIFKASLTKLIDYFKLGFSRHESYRHYKFNWKKSDEYKDIDEFYQDTIESCYQIIHQPINWDVVEEYTKEGKIYLFQIYNKDFSPHSKGTPNMHTLYWKTLFDEQNLANVVYKLNGEAEIFFRKASLERKVTHPANEPIKTKNPKSKKEKTFAYDLIKDKRYTEDKFQLHVPITMNFKSPMEKKGINSRVNNYIKTAEDLHFIGIDRGERNLLYVCVIDSKGNIKDQYSLNEIVNQYNRTDYKYLLEKREEERDKERKSWQTIENIKDLKQGYLSQVVHKIAQLMVQYHAIVVLEDLNSGFKRSRQKVEKSVYQQFEKSLIDKLNYLVDKQLPIDEEGGVLRAYQLTNKFESFKTMKMQNGFLFYIPAWNTSKMDPTTGFVNLFDTRYTNIDKSKEFFDKFEAIRYNEGKDWFELEFDYENFTEKAEGTQTQWTLCTWGERINTFRNKSKNSSWDYKKINLTEEYKALFEQFSINYRGNLKKEILEQNSKDFFERLLSLLRLTLQMRNSIPKTDTDYLISPVADANGSFYYSEQCGDNLPKNADANGAYNIARKGMWMAEQIRRSNEGEKLKLAISNKEWLRFAQEKPYLEDK

SEQ ID NO: 179 - protein, 1227 aa, unidentified
MKNLYSDLHNLYGLSKTLRFELQPVGRTKENFENYILDSDEEKSEKFKKVKAYCDEVHKNFIKNCLEKIDLADIKPLLKRYYELFLINNRSEQEDKEFEKIQENLCKKISGNFKNNDLYKGLFEKDMIKKYLPEYFKNDKEKLKEISLFFDFTTYFTGYHKNRQNMYSEENKSTAISFRLIKQNLPTFIKNMQNFKKIQNVIPTIGKTLTSKLGINIEYLFSNVEVYAECLTQKAIDMYNCAIGGKTLDNGEKIQGINEFINLYNQQNPNKKLPKLKFLYKQILSDNTSVSFKIDKIEDDKELIDLINSYYEKLKPVIESIDKVSGETELVLAIKNLSNYDLSRIWINQYDLTNVSQQVYGDWSYITHLLEEEYNSQNPKGAKQSIEKYNEKRSKDLKKIKEYSFAHLNSLVAQNDDCAKNKLYTYFVENLLKIITDIKSSQLQCNEILTRNHEENNKTLLGDFSSISLIKDFLENMKKLQNLVKTFMPKTIGIETDDLFYNALNYEILSEIIPVYNKVRNYVTQKSYSVEKFPLTFHCPTLLDGWDLNKEESNLSILFEKDGFYYLGIMNKKDNKIFKNIQPTKENEEVYRKIEYKLLPGPNKMLPKVFFSESRITEFNPTNELLSKYKKGCHKKGIDFDINFCRDLIDFYKKSLSIHQDWSQFNFKFDDTNKYQDISKFYRQVEEQGYRISTTNISEKYIDSLVEDGKLFLFKIYNKDFSEYSKGTPNLHTLYWKALFDEDNLKNVVYKLNGGAEIFYRKKSIEYKITHPKNQLIKNKNELNDKKESIFDYDLIKNKRFTMDKFLFHVPITLNFKSKNLEYINELVNLKIKENNNINVIGIDRGERNLIYLTVVNSKGELLEQLSLNEIVNEYNDKTYRTNYHDLLNKKEQERNEARKSWGAIKNIKELKEGYMSQVIHKITDLMIKYNAIIVLEDLNSGFKNSRKKVEKQVYDKFETMVINKLSYFVDKKQGKFDEGGLLNAYQLVNKDSKGKQSGVLFYIPAWNTSKIDPVTGFVNLFCIKNMSIEKAKEFFNKFENIKYNKEENFFEFDFDYSKFSDKACGIRKDWTICTYGERIKTFRNPSKNNQWDNEEIKLTEKFKELFEKYSINLLNIKNGIQNQTEKKFFDSLIGLFKLTLQMRNSVTNTDIDYILSPIKDKNGNFYDSRKNIKTLPKDADANGAYNIARKGLMLIEQIKETENLSKLKLKSITNEQWLTYVQEKNR

SEQ ID NO: 180 - protein, 1072 aa, unidentified
MYSDEEKSTSIAFRLIHENLPKFIDNMEVFAKIQNTSISENFDAIQKELCPELVTLCGMFKLGYFNKTLSQKQIDVYNTVIGGKTTSEGKKIKGLNEYINLYNQQHKQEKLPKMKLLFKQILSDRESASWLPEKFENDSQVVCAMVNFWNTIHDTVLAEGGLKTIIASLGSYGLEGIFLKNDLQLTDISQKVTGSWSKISSEIKQKIEVMNPQKKKESYESYQERIDKIFKSYKSFSLAFINECLRGEKIEDYFLKLGAVNTSSLQKENHFLHIFNAYTDIKEVIDSYSESTETKLIRDNDSIQKIKQFLDAVKDLQAYVKPLLGNGDETGKDERFYGDLIEYWSLLDLITPLYNMVRNYVTQKPYSVDKIKINFQNPTLLNGWDLNKEMDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKVIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNALGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 181 - protein, 1281 aa, unidentified
MLKSYDYFTKLYSLQKTLRFELKPIGKTLEHIKNSGIIESDETLEEQYAIVKNIIDKLHRKHIDEALSLVDFTKHLDTLKTFQELYLKRGKTDKEKEELEKLSADLRKLIVSYLKGNVKEKTQHNLNPIKERFEILFGKELFTNEEFFLLAENEKEKKAIQAFKGFTTYFKGFQENRKNMYSEEGNSTSIAYRIINENLPLFIENIARFQKVMSTIEKTTIKKLEQNLKTELKKHNLPGIFTIEYFNNVLTQEGISRYNTIIGGKTTHEGVKIQGLNEIINLYNQQSKDVKLPILKPLHKQILSEEYSTSFKIKAFENDNEVLKAIDTFWNEHIEKSIHPVTGNKFNILSKIENLCDQLQKYKDKDLEKLFIERKNLSTVSHQVYGQWNIIRDALRMHLEMNNKNIKEKDIDKYLDNDAFSWKEIKDSIKIYKEHVEDAKELNENGIIKYFSAMSINEEDDEKEYSISLIKNINEKYNNVKSILQEDRTGKSDLHQDKEKVGIIKEFLDSLKQLQWFLRLLYVTVPLDEKDYEFYNELEVYYEALLPLNSLYNKVRNYMTRKPYSVEKFKLNFNSPTLLDGWDKNKETANLSIILRKNGKYYLGIMNKENNTIFEYYPGTKSNDYYEKMIYKLLPGPNKMLPKVFFSKKGLEYYNPPKEILNIYEKGEFKKDKSGNFKKESLHTLIDFYKEAIAKNEDWEVFNFKFKNTKEYEDISQFYRDVEEQGYLITFEKVDANYVDKLVKEGKLYLFQIYNKDFSENKKSKGNPNLHTIYWKGLYDSENLKNVVYKLNGEAEVFYRKKSIDYPEEIYNHGHHKEELLGKFNYPIIKDRRYTQDKFLFHVPITMNFISKEEKRVNQLACEYLSATKEDVHIIGIDRGERHLLYLSLIDKEGNIKKQLSLNTIKNENYDKEIDYRVKLDEKEKKRDEARKNWDVIENIKELKEGYMSQVIHIIAKMMVEEKAILIMEDLNIGFKRGRFKVEKQVYQKFEKMLIDKLNYLVFKNKNPLEPGGSLNAYQLTSKFDSFKKLGKQSGFIFYVPSAYTSKIDPTTGFYNFIQVDVPNLEKGKEFFSKFEKIIYNTKEDYFEFHCKYGKFVSEPKNKDNDRKTKESLTYYNAIKDTVWVVCSTNHERYKIVRNKAGYYESHPVDVTKNLKDIFSQANINYNEGKDIKPIIIESNNAKLLKSIAEQLKLILAMRYNNGKHGDDEKDYILSPVKNKQGKFFCTLDGNQTLPINADANGAYNIALKGLLLIEKIKKQQGKIKDLYISNLEWFMFMMSR

SEQ ID NO: 182 - protein, 1267 aa, unidentified
MESMKDLTGQYSLSKTLRFELKPIGKTLEHIEQKGLLTQDEQRAEEYEQMKGIIDRYHKAFITMCLRNCKIKVNNTDDELDSLEEYSSLLSKSKRDADDENKLEKIKENLRKQIVNAFKSGNTYGDLFTKELIKNHLPDFVTDEEEKQVVEHFCNFTTYFTGFHDNRKNMYSDKAKSTAIAYRLIHENFPRFFDNLRSFAKISESEVANRFPEIESAFSLYLNVEHIADMFHVDYFPVVLTQEQIDVYNNIIGGKTEEDGTKIQGINEYINLYNQHHPDVKLPFLKPLYKMILSDKVALSWLPEEFENDEEMLTAINDFYKSVQPVVFGDDENCIRHLLTNIAEYNTDHIYISNDLGLTGISQQLFDQYSIFEDVIKDELRRNVKQTPKEKRNPELLEERIKNLFKKEKSFSISYLDSLIKDKGEDTIESYYAKLGAFDRDGKQTVNLLTQIEMAYIAAKEVLDGKYDNINQSEEATKYIKDLLDAFKSLQHYIKPLLGSGEEAEKDNVFSSQLLNVWEALDVVTPLYNKVRNWLTRKPYSTKKIKLNFENVQLLGGWPNIEAYSCAIFMKDDNTYYLGILDNAYKTLLRDFPEPAEEKDTIGLMHYLQGGDMGKNIQNLMVVDGKVRKVNGRKEKSGINVGQNIRLEEAKKRYLPTEINRIRKLGTYSVSNPNYNKQDLITIIDYYKPLACEYYASYTFHFKDSSEYNSFAEFTDDINQQAYQLGFVPFSQQYLNKLVDEGKLYLFQIWNKDFSDYSKGTPNMHTLYWKALFDKANLADVVYKLNGRQAEVFYRKRSLQKENTTVHKALQPIKNKNTQNEKSTSTFDYDIVKDRRYTVDKFHFHVPITINFKSSGKPNINEHVLDIIRHHGIEHVIGIDRGERHLLYLSLIDLKGRIIKQMTLNEIKQQTGGNYGTNYKELLAAREGDRAEARRNWKKIENIKDLKAGYLSQVVHVIAQMMVEYNAIVVLEDLNMGFMRGRQKIERSVYEQFEHMLIDKLNFYVDKKKEACAPGGLLHGLQLANKFESFNKLGKQSGCLFYVPAWNTSKIDPVTGFVNMLDARYESVESSRRFFSRFDVIRYNEEKNWFEFTFDYNNFHAKLDGTKTQWTLCTYGSRIKTFRNPAKLNQWDNEEVVLTDEFKKVFANAGINIHGNLKEAICSLAKREHLEPLMHLMKLLLQLRNSKTNSEVDYMLSPVADNGVFYDSRSCNGNLPIDADANGAYNIARKGLWVLRQIQDSKPGDKLNLALSNKEWLRFVQEKSNFE

SEQ ID NO: 183 - protein, 1242 aa, unidentified
MNTYEELTGSYSLTKTISLALNPIGETLRHIEEKGFIAQDEQRAEDYKKVKDIIDRYHKYFITMCLDRFKFSTDKLMKYVALAENAKRDEDAFDEVKTQLRKEIVAAFEKGETYKDLFKKELILEHLPNFVTDENEKRLVASFNKFTTYFTGFHENRENMYSDEVKSTAIAHRLIHENLPMFYDNLKSFKKIVACEDCIDFAEFEAAFSEEFKEFKVEHLADIFQLEYFNNTLTQRKIDFYKLVIGGKVLEDGTKLKGVNEYVNLYNQQHKDARLPLLKPLYKMILSDKVALSWLPEEFKSDEEMVEAIQEMHKNLKGALTDNAENNLRDLLLNMDKYDLAHIYIANDLGLTDISQNIFGQYDVYTSALKQALRNEYAPTPKERRNPELYDERINKLFKSRTSFSIAELNSLADSDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPADGNCYEKIDYKQIALPMGLGAFVRKCGKTAEKLGWSCPKNLKNKDKKIITNDAEAEGVLPDLIDCYKAFLNTYEKDGFKYKDFNFKFKPSSEYSSLVEFFAEVPSQGYKIAFRKVSVAYINQLVESGKLYLFQIWNKDFSKFSKGTPNMHTLYWKQLFDERNLADVVYKLNGQAEVFYRKRSLKLEETTVHQAHQPIPNKNKQNEKRQSQFNYDIVKNRRFTVDKFQFHVPITLNFKATGRGNINDKVLEIIRNNGIKHVIGIDRGERHLLYLSLIDLKGNIIKQMTLNDIVNEYRGHTYATNYKDLLAEREDNRTEARRNWKKIDNIKEIKQGYLAQVVHIISKMMVEYKAIVILEDLNMGFMRGRQKIERSVYEQFEKSLIEKLNYYVDKQKDEEEVGGLLHALQLTSKFKSFKELGKQSGCLFYVPAWNTSKIDPVTGFVNLFDTKSVKGEKVRAFFSNFDTIRYNAEKDWFEFAFNYSNFTDKAKDTREKWTLCTHGTSIRTFRNPSKLNQWDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPKLAIKNKEWLKFAQQKPYLDD

SEQ ID NO: 184 - protein, 1111 aa, unidentified
MVQFINTANLKQRLNLSKEEAKDLVQEFCGFTTYFGDFYQNRENMYSAEEKSTGIAYRLINENLPKFIDNMETFKKIAAIPEMEDNLKEIHDNLSEHLNVENIQDMFQLNYYNQLLTQKQIDVYNAIIGGKTDDEHKEKIKGINEYVNLYNQAHKDAKLPKLKTLFKQILSDRNAISWLPEEFDNDQETLNAIKDCYAHLSGNILKDENLKRLLCSLSEYDTKGIFLRNDSQLTSISKKMSGSWTDIPSAIKNDMKDGVPAKKRKESEEDYEKRIDNLFKKQDSFSIDYMDACLNKFVENNPYTIEGYFKELGAKDTQSEDIFKQIENAYTDVKPLLNSTYPKNKNLSQDKENVAKIKRFLDTLMSLVHFVKPLLGKGDERNKDEKFYGELSLLWTELETIVPLYNMVRNYMTRKPYSNSKIKLNFDNSQLLGGWDANKESDYSSILLYRDGKYYLAIFDKDSKKLLGKSMPSDGECYEKMVYKLLPGANKMLPKVFFAKSRIKDFKPSEQLLEKYNKGTHKKGKNFSISDCHALIDFFKQSINKHEDWKNFDFNFSETSTYEDLNSFYREVELQGYKITFTKVSASFIDKLVEEGKVYLFQIYNKDFSEYSKGTPNMHTLYWKALFDDRNLKDVVYKLNGQAEMFFRKKSINCNHPTHPANQPIQNKNKDNKKKESVFEYDLIKDHRYTVDKFMFHVPITMNFKSTNEKDINLHVREYLQTSNDTHIIGIDRGERHLLYLVVIDLHGNIVEQYTLNDIVNEYNGNTYRTNYHDLLDAREEDRLKQRQSWQTIENIKELKEGYLSQVIHKITQLMIKYHAIIVLEDLNIGFMRGRQKVEKQEYQKFEKMLIDKLNYLVDKKADIESTGGLLNAYQLTNKFASFKKLGKQSGFLFYIPAWNTSKIDPVTGFVNLLDTRYQNVDKAKAFFAKFDSIRYNKDKDWFEFALDYNNFGSKAEGTRTKWTLCTQGKRIKTSFNKMSSKWNNQEIDLTKDLKQLFVQYDIDINGNLKEAISKQTKYTFFVELMGLLKLTLQMRNSITGTETDYLVSPVADENGNFYDSRMLFLKTDFLFTSSCLQSRSTILLSSCLESSSLTGARRFLFLIRSAMNSR

SEQ ID NO: 185 - protein, 1313 aa, unidentified
MLDRFTNQYSVTKTLKFELRPMGKTLEHVQKKGFVETDEKLATNYKRIKKTIDVYHKDFISRALSQLSISNLDEFLASYEDNKKNPDDKTKKQLVRIQDNLRKQITSAFTAAEFKTEFSELFKKELLTKNLESFVLEYNKKNDADLFFVDDFKNFATYFIGFHENRKNIYSADAKHTALAFRIIHENLPKFIENMNSLQLIKDDYPALYESLQNQVSTELSSIFSAGFVLDDVLNISFYNELLSQQGIDRFNQLIGGVSTQSGAKKTQGLNELINEYNQQSPRSSGNRKAPKIRPLYKQILSDRGSLSFLPEKFADDRELYDAINDYYLSHLLMVPNDSSEHTLLDSLKHLVASLPSFDLTKIYLKNDKAISSISNRLFGDYSVLPIALGYYYDHHINPDHLDQLAAAKSQKKTSDLYKKKDAFTKGYHSVATIEAAYQAYLASTDSDNGLRKSGIINPVQDYFTRYFVNEPKEDGKAAVDLLRDIDNKYTTIKGVLNSEIEEGTRQLLQKGAEVANIKHFLDAVMNLIHFVKPLGSVIEEDSLLDIDARFYNDFLPLYEELKLFFPLYNKVRNYISQKPYSNEQFKLNFENANLLEGWDVNKEKSRLSVLLQRDGRYYLALMDKSHKKVFEQAPEITPGSENSNSPYQKMRYKLLPGPNKMFPKVFFAKGNIDYFAPSQQLLENYEKGTHKKGDDFNIEHCHQLIDFFKQSVAKHKDWHEFGFKFSDTSTYKDISEFYNEVSKQGYKVTFEDVDADYIDTLVENGQLYLFEIYNKDFSVNSRGKPNLHTIYFKALFDDENLKDAVYKLNGEGELFYRKASIDPENTIKHKKGERVYSKNPLTPDASRVLDYEIVKDKRYTADKFLLHLPVTMNFKADGIGPGQFNNLVKDTIRDDQNKDMHLIGIDRGERHLLYLTVINQDGLIIHQESLNDVVSSNKTVTPYHTLLDTREKERDDARKNWGVIENIKDLKKGYLSQVVHKLAKLIYEYNAVVVLEDLNFGFKRGRFKVEKQVYQAFEKALIDKLNYLVFKEFESDALGGARKALQLTSAFTAFKDLGKQTGFLFYVPAWNTSKIDPVTGFVDLLKPKYENVEQAKDFIDRFDSIRYNKEKDFFEFEFDYSNFGTRAQDTRTDWTICSHGTKRYVYDKNANNNKGGQKQIDVNTELKALFSSYDIDYHGELAGRDLRPMIKSKGDKSMYSSIIFLLKTLLAMRYSKTNGSKVEDFILSPVSNDAGVFFDTRDYDGMDADSSSETSTVLPKDADANGAYHIALKGLWVMRQIQSHTGDDYKGLDLKITNKNWLEFVQTKPYQK

SEQ ID NO: 186 - protein, 1308 aa, unidentified
MDKNFDDFKRLYPLKKTLRFEAKPIGATLKNIIKSGLLEEDEHRAQSYVKVKKLIDEYHKVFIDRVLNEGCLTIENKGNKDSLEEYYESYMSKSNDENANKAFKEIQRNLRSVIANKLTKDKGYANLFGKNLIESYKDKEDKNKNKIIDSDLIQFINTAEPSKLDSMSQDEAKELVKEFWGFTTYFEGFHKNRKNMYTSEEKSTGIAYRLVNENLPKFIDNMEAFKKAIAKPEIQANMGELYSNFAENVESIQEMFQLDYYNMLLTQKPIDVYNAIIGGINEYIYLYNQQHKNEKLPKLKALFKQILSDRNAISWLPEEFNSDQEVLDAIKDCYERLSENVLGDKVLKSLLCSLSDYDLNGIFVRNDLQLTDISQKTFGNWSVIQNAIMQNIKNVAPARKRKESEEDYEKRISDIFKKADSFSIQYINDCLNEMDDNNLHAVDGYFATLGAVNTPTMQRENLFALIQNAYTDISDLLDTPYPENKNLAQDKTNVAKVKALLDAIKSLQHFVKPLLGMGDESDKDERFYGELASLWTELDTVTPLYNMIRNYMTRKPYSQKKIKLNFENYQLLEGWDANKEKDHAAIILRRNGMYYLAIMDKDSKNLLGKTMPSDGECYEKMVYKQFDISKQLPKCTTELKRVKKALVEDAKRSFLLSDSKDWNKPLNVTRKLWELNNYVWDKKKADWVLGKKENETRPKKFHKEYLELTSDKKGYNQAKNDWIKFTKEFLSSYKKVEDYDIHYKKRYNSVDELYNQLVGDFYTISFTYVSVSFIDKLVNEGKMYLFQIYNKDFSNYSKGTPNMHTLYWKALFDERNLADVVYKLNGKAEMFYRKKSIDNTHPTHPANHPIQNKNKENKKKESVFKYDLVKDHRYTVDKFMFHVPITMNFKSVGSENINQQVKEYLQQADDTHIIGIDRGERHLLYLVVIDMEGNIKEQFSLNEIVNEYNGNTYRTNYHDLLDVRADKRLKASQSWQTIENIKELKEGYLSQAIHKITQLMVKYHAVVVLEDLNKGFMRGRQKVEKQVYQKFEKMLIDKLNYLVDKHKDANETGGLLHALQLTSEFKNFKKSDPQSGFLFYIPAWNTSKIDPVTGFANLFDTRYTNADKALEFFSKFDEIRYNEEKDWFEFEFDYDEFTQKAHGTRTRWTLCTHGKRLRSFRNPAKQYNWDSEVVALTDEFKRILGEAGIDIHENLKDAISNLEGKRRKYLEPLMQFMKLLLQLRNSKAGTDEDYILSPVADENGIFYDSRSCGDELPENADANGAYNIARKGLMMIEQIKDAKDLDNLKFDISNKAWLNFAQQKPYKK

SEQ ID NO: 187 - protein, 1260 aa, unidentified
MKNFTNIYPQSKTLKFELRPYGATLDNIHKSGLIDQDETLKADYHAVKKMIDEYHKVVIDESLTNFKLTDLPAYEELYYKSRTEVEDKEFEIVQSNLRKQIHKAFSENKRFKSIFKKELIQKDLPAFVKKEEEREQISRFYHFTTYFTGFHENRKNIYTAEAKATSVCNRLIHENLPKFLDNRKTYLNYISNFIDLDLSQVEEDLQEVLGDITVDDLFSLDSFNHTLTQRDIDIYNLALCGRSIEGEKKIQGINECINIYRQKNRLKARQLPNIKPLYKQILSESKSGSFLLDKFEKDEDLFDSLRNFYHCLNSFNYKGEQDKSTFIELMTLFGRFSESDMTRVYLRNDASLSRLSKKLFGDWSLIVSALKYYYDAEANPLMGKKATNKYIKEKENWLNKSSNFSIDVINKSLLRYGTINETVNSQFTDDMIFEHFSSFMIEEKNLLNTVAENFMLVSEVVSRGSLDKNQNKKKTEVKTIKTFLDTVLDLLHFIKPLSVQYVGAEKDEGFYSDFDVLYDQLSQVIPVYNKTRYYLTKKPYSMEKFKMNFKNNTLLDGWDVNKETANKGILLQKEGLFYLAIMNKDHSKSFYNIMDTGDTTGYQKMNYKLLPGPNKMLPKVFFGVKNLNFFNPSDEVLRIRNTSSHSKNGNPQEGFEKADFSLSDCHSLIDFFKASLNKHTDWKKFAFDFSPTQSYNDISEFYREVENQGYKITYTNISDAYIHELVKEGKIYFFQIYNKDFSPFSKGKPNLHTLYWRALFDEKNLADVVYKLNGQAEVFYRKKSIEYSEEKWIQGHHHEQLKDGFAYPIIKDKRFAFDKFQFHVPITMNFKALGAPVINMKVREYLKTNPDVKIIGLDRGERHLLYLTLIDQNGNIEEQYSLNEIVNSYNGKVYKKDYQQLLHVKEGDRKKAKKNWETIEAIKELKEGYLSHVVHKIVNMMVEHNAIVVMEDLNFGFKRGRFHIEKQIYQKFEKMLIDKLNYLVLKDTQDPKTPTGLLNALQLSNKFESFQKLGKQSGFIFYLPAYLTSKIDPTTGFVNQLRIKYDSIVKSQAYYRQFDTIVYNNTSDWFEFSFRYVNFANTTPSARKIPWTICTTHHPRYAWNINSNVGNGGTEEYNVTKELKKLFDQHKIAYEEGTDLIESIASNTAVDFFKRLNKLLYITASLRHNNGKKGKEEHDFILSPVANSEGGFFNSLEADETQPENADANGAYHIALKGLWALQSIRKTDTDRLSKLNLAVSNEEWLNFAQAKQYRSQNSS

SEQ ID NO: 188 - protein, 1309 aa, unidentified
MKLNKFTHQYPISKTLRFELKPVGETADYIEDFKSQYLKDIVIQDQQRAEDYESIKVIIDEYHRHYIEEKLSEPFDKKTGELFISGDEFENAFSYYQRFRENSKDEKARKEWIEVQNSLRKSLVKVFSDRKKRLFQKELITKELPSWLKEKGEWEDKKNVVENFNRFTTYFTGFNENRENMYSHEEQSTAISFRLMNENLPKYFNNCIQYHKAIESYDGLSFTVNPDLLNEMGVSILSEIFQPSYYIQLFTQSGIDKFTELLGGFTKENGEKVQGLNETINLFRQQKAIKAKAFPNFISLYKQILSDRETSSFIPDQFENDNDLLKSLGKFIKEMVKEDGLFKKLEDSIKLITDADLHRTFIKNGVEITKISQSIFGNYSILKSAIYHHAESVLYPDPISGKISEALKEKRIKYVNKQVVFSIAELETILSNYASQMTDDNPDKEIIAQCENSEHPIRTYFLNAIENVKNDKDIEFGKAIENVLPLISLENLNKGKDGQAQTHKIQKMLDAFLAVTHAVKPLHLVKGRKPIDIPDMDMGFYAEFSKAFENFEQLVITLYNKTRNHLTKKTFSTDKIKINFENPTLLDGWDANKEKDNSGVLFEKDGNYYLGIMHPKHKNIFNYIKGINDIESEKRSLSKDELFNKIVDGESEHYQKIVYKLLPGVNKMLPKVFFSGRRIDFFAPSTEVLKIRNSASHSKNGSPQKGFEKEDFNLKDCHTIIDFFKKSIEKHPEWKEFEFEFSPTSSYEDLSGFYREVEHQGYKMDFHPIKKSYIDQCIEEGKLFLFQIYNKDFSPYSKGKPNLHTLYWKALFDTENLKDVVAKLNGQAEIFYRKHSIKKDERTIHRANKSLQNKNENNPKKTSLFEYDIIKDRRYTVDKFQFHVPITLNFKMEKMTQFAHNEKVNQMIVKSENTHVIGIDRGERHLLYYSVINPKGHIVEQGTLNTISTDKGYEVDYQQKLDSKEKARDTARKSWTTVENIKELKAGYLSHVIHKIAFLIEKYNAIVCLEDLNFGFKRGRFKVEKQVYQKFEKALIDKLNYLVFKDAKPNEPGHVLNAFQLTAPFDSFKKLGKQTGLLYYVQASYTSKIDPVSGFINFLYPKYESLLKSKIFFESMDGIRYNADKDYFEFSFDYRKMTPNRNLEGYQTKWTACTFGEKRFKNIRNAHGNWESVEVNVTEALKKILKNEDVDFKSGHDLRFEISKVKSTKFYKKLFKLLQITLSLRHSKTGTDEDFILSPIVDENGKFFDSRNATKDQPMDADGNGAYHIALKGLWNLEQIRNWDGESRLNLAMKNVDWFSFAYQKPFKK

SEQ ID NO: 189 - protein, 1273 aa, unidentified
MAKNFEDFKRLYPLSKTLRFEAKPIGDTLDNIIKSGLLDEDEHRAASYVRVKKLIDEYHKAFIDRVLNDGCLTIENKGKKDSLEEYYESYMSKSNDENANKTFKEIQKNLRSVIANKLTKDKGYANLFGKNLIESYKDKEDKNKIIDSDLIQFINTAEPSKLDSMSQDEAKELVKEFWGFTTYFEGFHKNRKNMYTSEEKSTGIAYRLVNENLPKFIDNMEAFKKAIARPEIQANMGELYSDFSEYLNIESIQEMFQLDYYNMLLTQKQIDVYNAIIGGKSDEENNVNIKGINQYINKYNQHHKDEKIPKLKALFKQILSDRNAISWLPEEFNSDQEVLNAINDCYKRLSENVLGDKVLKSLLCSLSDYNLNGIFVRNDLQLTDISQKMFGNWCVIQNAIMQNIKNVAPTRTRNESEEDYEKRISGIFKKADSFSIQYINDCLNETDENNIHAVDGYFATLGAVNTPTMPRENLFALIQNAYTDISDLLDTPYPTEKKLAQDDPNVTKIRTLLDAIKSLQHFVKPLLGKGDESDKDERFYGELASLWTELDTVTPLYNMVHNYMTRKPYSQKKIKLYFGNPQLLAGWHANKEKDNATIILRRNGLYYLAIMNKDSKNLLGEAMPSEGECYEKMVYKSLTHVERMIPKCSTQLKAVQAYFKVNTDDFVLNSKAFKKPLTITKEVFDLNNVFYGKYKKFQKEYLNATGDNVGYAHAVNVWIKFCMDFLNSYDSTCIYDFSSLRPESYLSLDAFFQDANSLLDNLSFTNVSESFINQLVKDKKMYLFQIYNKDFSANSKGTPNMHTLYWKALFDERNLADVVYKLNGQAEMFYRKKSIENTHPTHPANHPIQNKNKDNKKKESVFEYDLVKDRRYTVDKFLFHVPITMNFKSVGAENINQQVREYLQQADDTHIIGIDRGERHLLYLVVIDMQGNIKEQFTLNEIVNEYNGNTYRTNYHDLLDAREEERLKARQSWQTIENIKELKEGYLSQVIHKITQLMVKYHAIVVLEDLNMGFMRGRQKVEKQVYQKFEKMLIDKLNYLVDKKADAAQSGGLLNAYQLTSKFVSFQKLGKQSGFLFYIPAWNTSKIDPVTGFVNLFNTKYTNAVEAQEFFSKFDEIRYNEERDWFEFEFDYDKFTQKAHGTRTKWTLCTYGMRLRSFRNPAKQYNWDPEVVVLTDEFKRILGEAGIDIHENLKDAIRNLEGKRRKYLESLMQFMKLLLQLRNSRKNPEEDYILSPVADENGVFYNPQNEMLAFCKTKCSIRKTKRIFSIIPS

SEQ ID NO: 190 - protein, 1249 aa, unidentified
MKEQFINCYPLSKTLQFSLIPVGKTDDNFNKKLLLERDKQRAENYEKVKGYIDRFHKEYIESVLVNARVEKIDEYADLYWKSNKDDSDAKAMESLENDMRKQISKQLKSNARYKRLFGKELICEDLPSFLTDKEERETVECFRSFTTYFKGFNTNRENMYSSDEKSTAIAYRCINDNLPRFLDNVKSFQKVFDNLSDETITKLNTDLYNTFGRNIEDIFSVDYFEFVLAQSGIDIYNSMIGGYTCSDGTKIQGLNECINLYNKQDAKNEKSKRLPLMKQLYKQILSEKGSVSFIPEKFNSDNEVLLSIEDYYTAHIGDIDSLTELLQSLNTYNANGIFVKSGTSVTDISNGAFNSWNVLRLAWNEKYEALHPVTSKTKLDNYIEKRDKIYKAIKSFSLFELQSLGNENGNEITDWYISSSKECNSKIKEAYLQARELLKSDYEKSYNKRLSKNGKATELVKNLLDAIKDFQHLVKSLNGTGKEENKDELFYGKFTSYYDSIADIDRLYDKVRNYITQKPYSKDKIKLNFDNPTFLKGWALGNEFANSAQLLKDGDNYYLAIMDKELKNNIPKKYNSPTNEEDILQKIIYQQAADPSKDIPNLLVIDGVTVKKNGRREKTGIHAGENIILENLRNTYLPDNINRIRKEKTFSTSSENFSKDDLYEYIQYYICRAQEYYSSYNFTFKNASEYKSFPEFLYHVNSQAYQISYDNISKKQIMELADNGYIYLFEIYNKDFSKYSKGTPNLHTLYFKMLFDERNLSNVVYKLNGEAEMFYREASINDKEKITHQANQPIKNKNPDNEKKESTFEYDIIKDKRFTKRQFSLHVPITINFKAHGQEFLNYDVRKAVKYKDDNYVIGIDRGERNLIYISVIDSNGKIVEQMSLNEIISDNGHRVDYQKLLDTKEKERDKARKNWTSVENIKELKEGYISQVVHKICELVVKYDAVIAMEDLNFGFKRGRFPVEKQVYQKFENMLISKLNLLIDKKADPTEDGGLLRAYQLTNKFDGVNKGKQNGIIFYVPAWDTSKIDPVTGFVNLLKPKYTSVSEAKKLFETIDDIKYNVNTDMFEFCIDYGKFPRCNSDYKKTWTVCTNSNRILTCRNKEKNNMWDNKQIVLTDEFKSLFGEFGIDYKGNLKTSILSISNADFYRRLIKLLSLTLQMRNSITGSTLPEDDYLISPVANDRGEFYDSRNYKGTNAALPCDADANGAYNIARKALWAISVLKSTPDDMLNKANLSITNAEWLEYTQK

SEQ ID NO: 191 - protein, 1249 aa, unidentified
MKEQFINCYPLSKTLQFSLIPVGKTDDNFNKKLLLERDKQRAENYEKVKGYIDRFHKEYIESVLVNARVEKIDEYADLYWKSNKDDSDAKAMESLENDMRKQISKQLKSNARYKRLFGKELICEDLPSFLTDKDERETVECFRSFTTYFKGFNTNRENMYSSDEKSTAIAYRCINDNLPRFLDNVKSFQKVFDNLSDETITKLNTDLYNTFGRNIEDIFSVDYFEFVLAQSGIDIYNSMIGGYTCSDGTKIQGLNECINLYNQQVAKNEKSKRLPLMKPLYKQILSEKDSVSFIPEKFNSDNEVLLSIEDYYSSHIGDFDLLTELLQSLNTYNANGIFVKSGAAVSDISNGAFNSWNVLRLAWNEKYEALHPVTSKTKLDNYIEKRDKIYKAIKSFSLFELQSLGNENGNEITDWYISSSKECNSKIKEAYLQARELLKSDYEKSYNKRLSKNGKATELVKNLLDAIKDFQHLVKSLNGTGKEENKDELFYGKLTSYYDSIADIDRLYDKVRNYITQKPYSKDKIKLNFDNPTFLKGWALGNEFANSAQLLKDGDNYYLAIMDKELKNNIPKKYNSPTNEEDMLQKIIYQQAADPSKDIPNLLVIDGVTVKKNGRREKTGIHAGENIILENLRNTYLPDNINRIRKEKTFSTSSENFSKDDLYEYIQYYICRAQEYYSSYNFTFKNASEYKSFPEFLYHVNSQAYQISYDNISKKQIMELADNGYIYLFQIYNKDFSKYSKGTPNLHTLYFKMLFDERNLSNVVYKLNGEAEMFYREASINDKEKITHQANQPIKNKNPDNEKKESTFEYDIIKDKRFTKRQFSLHVPITINFKAHGQEFLNYDVRKAVKYKDDNYVIGIDRGERNLIYISVIDSNGKIVEQMSLNEIISDNGHRVDYQKLLDTKEKERDKARKNWTSVENIKELKEGYISQVVHKICELVVKYDAVIAMEDLNFGFKRGRFPVEKQVYQKFENMLISKLNLLIDKKADPTEDGGLLRAYQLTNKFDGVNKGKQNGIIFYVPAWDTSKIDPVTGFVNLLKPKYTSVSEAKKLFETIDDIKYNANTDMFEFCIDYGKFPRCNSDYKKTWTVCTNSSRILTCRNKEKNNMWDNKQIVLTDKFKSLFGEFGIDYKGNLKTSILSISNADFYRRLIKLLSLTLQMRNSITGSTLPEDDYLISPVANDRGEFYDSRYYKETNAALPCDADANGAYNIARKALWAISVLKSTPDDMLNKANLSITNAEWLEYTQK

SEQ ID NO: 192 - protein, 1254 aa, unidentified
MKEQFINCYPLSKTLRFSLIPVGKTEDNFNKKLLLENDKQRAENYENVKSYIDRFHKEYIKSALANARIEKINEYAALYWKSNKDDSDAKAMESLEDDIRKQISKQLTSTANFKRLFGKELICEDLPAFLTDENEKETVECFRSFTTYFNGFNTNRKNMYSSEKKSTAIAYRCVNDNLPRFLDNIKTFQKIFDNLSDETITKLNTDLYNRFGRKIEDIFSVDYFDFVLAQSGIDIYNSMIGVYTCSDGTKIQGLNKCIDLYNQQAAKNEKSKRLPFMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLKSDYEKDYDKRLYKNEKATELVKNLLDAIKKFQQLVKPLNGTGKEENKDELFYGKFTSFYDSVADIDRLYDKVRNYITQKPYSKDKIKLNFDNPTFLKGWALGNEFANSAQLLRDGDNYYLAIMDKEFRNNIPKKYNSPISKEDVLQKIIYQQAADPSKDIPNLLVIDGVTVKKNGRKEKTGIHAGENIILENLRNTYLPENINRIRKEKTFLTSSENFSKDDLCEYIQYYICRAQEYYSSYNFTFKNASEYKSFQEFLDDVNSQAYQISYDNISKKQIMELVENGYLYLFKIYNKDFSKYSKGTPNLHTLYFKMLFDERNLSNVVYKLNGEAEMFYREASINDKEKITHHANQPIKNKNPDNEKKESVFEYDIVKDKRFTKRQFSLHVSVTINFKAHGQEFLNYDVRKAVKYKDDNYVIGIDRGERNLIYISVINSNGEIVEQMSLNEIIGDNGYSVDYQKLLDKKEKERDKARKNWTSVENIKELKEGYISQVVHKICELVIKYDAVIAMEDLNFGFKRGRFPVEKQVYQKFENMLISKLNLLIDKKAEPTENGGLLRAYQLTNKFDGVNKAKQNGIIFYVPAWDTSKIDPVTGFVDLLKPKYTSVREAKKLFETIDDIKYNTNTDMFEFCIDYGKFPRCNSDFKKTWTVCTNSSRILSFRNEEKNNEWDNKQIVLTDEFKSLFNEFGIDYTSDLKASILSISNADFYNRLIRLLSLTLQMRNSITGSTLPEDDYLISPVANDRGEFYDSRNYKGSNAALPCDADANGAYNIARKALWAINVLKDTPDDMLQKAKLSITNAEWLEYTQRWANSL

SEQ ID NO: 193 - protein, 1250 aa, unidentified
MKEQFINRYPLSKTLRFSLIPIGETENNFNKNLLLKKDKQRAENYEKVKCYIDHFHKEYIESVLSKARIEKVNEYANLYWKSNKDDSDIKAMESLENDMRKQISKQLTSTEIYKKRLFGKELICEDLPSFLTDKNERETVECFRSFTTYFKGFNTNRENMYSSDEKSTAIAYRCINDNLPRFLDNVKSFQKVFDNLSDETITKLNTDLYNIFGRNIEDIFSVDYFEFVLAQSGIEIYNSMIGGYTCSDKTKIQGLNECINLYNQQVAKNEKSKRLPLMKPLYKQILSEKDSVSFIPEKFNSDNEVLHAIDDFYTGHIGYIDLLTELLQSLNTYNANGIFVKSGVAITDISNGAFNSWNVLRLAWNEKYEALHPITSKTKIDKYIEKQDKIYKAIKSFSLFELQSLGNENGNEITDWYISSINESNIKIKEAYLQAQELLNSDYEKSYNKRLYKNEKATELVKNLLDAIKEFQKLIKPLNGTGKEENKDELFYGKFTSYYDSIADIDRLYDKIRNYITQKPYSKDKIKLNFDNPTFLKGWALGNEFANSAQLLKDGDNYYLAIMDKELKNNIPKKYNSPTSEEDMLQKIIYQQAADPSKDIPNLLVIDGVTVKKNGRREKTGIHTGENIILENLRNTYLPDNINRIRKEKTFSTLSENFSKDDLYEYIQYYICRAQEYYSSYNFTFKNASEYKSFPEFLGHINSQAYQISYDNISKKQIMELVENGYIYLFQIYNKDFSKYSKGTPNLHTLYFKMLFDERNLSNVVYKLNGEAEMFYREASIGDKEKITHYANQPIKNKNPDNEKKESVFEYDIVKDKRFTKRQFSLHLPITINFKAHGQEFLNYDVRKAVKYKDDNYVIGIDRGERNLIYISVINSNGKIVEQMSLNEIISDNGHKVDYQKLLDKKEKDRDKARKNWASVENIKELKEGYISQVVHKICELVIKYDAVIAMEDLNFGFKRGRFPVEKQVYQKFENMLISKLNLLIDKKADTTEDGGLLRAYQLTNKFDGVNKAKQNGIIFYVPAWDTSKIDPATCFVNLLKPKYTSVPEAKKLFETIDDIKYNANTDMFEFYIDYSKFPRCNSDFKKSWTVCTNSSRISTFQNKEKNNMWDNKQIILTDEFKSLFNEFGIDYKGNLKDSILNISNADFYRQLIKLLSLTLQMRNSITGSTLPEDDYLISPVANESGEFYDSRNYKGTNAALPCDADANGAYNIARKALWAINVLKDTPDDMLNKAKLSITNAEWLEYTQK

SEQ ID NO: 194 - protein, 1265 aa, unidentified
MKHLSDFTNKYQISKTLRFKLIPIGKTEEFIKRGQFIENDERRENEYKKIKGFIDEYHKLFIAEILSSLKLPLCQIESLYDWYAHRGSDPERKKNIKDIQAALRKTIANAFTKDKRYEKMFKKEMITEILPNFLTDEQDKSIVNNFKKFVSYFVNFHNNRKNIYSGEEKSTAISHRIVNQNLMKFLDNHTIFSSKVKSTLPDSIIIAIESDFNDILCGKSIEQLFSLDNFTHTLCQADIERYNAVIGGRTVESKNKEIKGINQYINEHNQICDKGDRIPLLKPLFNQILSDREKVSFVIEDFKKAPEAIHAIFDAYNSVISAQISKISTLLKSLNDYNLDGIFIKVGKDSSLVSAHHFGSHSLIADTIAENWEKEHPRGKTKPATYQKNKDKYLKTVTSISLGAINSFEKGAPIENYFMALGETDKPERQEISIPDKIKIAFSEFEKAFPEPDKCTTEYLQANVATIKSLLDLIKEYQWFVALLLGNGDESEKDENFYGEFTPSFEQFEQVITPLYNKVRNFLTKKPYSTEKFKINFENVTLLKGWDENKEKDNASIILRKDGLYYLGVFNNNSANILNNIWPCEGECYEKMVYKFFKDATTMIPKCSTQLNKVKEHFAKSCADFTLFDSKTFTSPITITKEIFDLNNITYDGKKKFQKEYLEKTGDQKGFSNALSTWKHFCLQFLKAYKSTANYDFSEIERNIDSYSDLPLFYQELNNFLYKVTFERVSADFIHQLVNEGCLYLFQIYSKDFSPYSKGKPNLHTIYWRMLFDEENLSNVVYKLNGEAEIFFRPSSIKCTGPTHLANQPIENKSEYNKKNKPSSTFGYDLFKDRRYTKDQFEFHAPITLNFKQPKPSMFNDEVRTFLKDNGVRHIIGIDRGERNLLYLVMVDLDGNIKKQISLNNIASNPNNTEFKQDFHAILHNREGDRQEARRNWSTIQNIKELKEGYMSLVVHEIVKLMLKEDAIVVLENLNRSFMQIRGGIEKSVYQKFEKMLIDKLGYIVDKDKAPTENGGALHAIQLADTFENYNKYQSGTVRQCGFIFYVPAWCTSKIDPTTGFVPMLKCKYENIESSQTFFSKFDSIRYNEAEEYFEFKTNYANFYTSSKGGKQQWNICTFGERILTQRAKDGHFESKTIALAPAFKELFAQAGINIQGNIKAQIVKQNDASFFKELHHLLRLTLQMRNSNSTTGDDYIISPVKNKDGEFFDSRRSGEKLPQDADANGAYNIARKGLMLMQQLNDTKANSKFKPDISNENWLEFAQK

SEQ ID NO: 195 - protein, 1332 aa, unidentified
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKNLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTIPEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGIFESFQKLGKQSGFLFYVPAGYTSKIDPATGFANLLDMTNLTNVQKKRDFFAKFDSICFDEEKQMFAFTFDYKNFPGKGSQEMSRTKWTVYSNGKRIQFCGKGKASKHIENITEEFKTLFREFDYQNGNNILDSILEVGAALKAGEKPAKEIADFWDKLLVLFKLVLQMRNSDAKTGDDYIISPVMSESGNFFDSREQEKLGNSAKLPKDADANGAYHIALKGLYLLKAFDKTPEDQLKKVDMKISNADWFRFAQEKEYSK

SEQ ID NO: 196 - protein, 1284 aa, unidentified
MKGLMLMPININKFSDECRKIDFFTDLYNIQKTLRFSLIPIGATADNFDFKDRLSKEKDLLDSAKRIKEYISKYLADESDKCLSQPIKLKHLDEYYELYITKDRDEQKFKSAEEKLRKELADFLKEILKRLNKKILNDYLPEYLEDDEKALEDIANLSSFSTYFNSYYDNCKNMYTDKEQSTAIPYRCINDNLPKFIDNIKAYEKVLEELKPSDLEELRNNFKGVYDTTVDDMFTLDYFNCVLSQSGIDTYNAIIGNDKVKGINEYINLHNQTAQQGRKVPNLKRLYKQIGSQKKTISFLPGKFESDNELLKAVYDFYNTGNAEKNFTALKDTITELEKIFDNLAEYNLDGVFVRNDISLTNLSQNMFNDWSVFRNLWNDRYDKVNNPEKAKDIDKYNDKRRNVYKKSESFSINQLQDLIATSLEENINSKKITDYFSCDFHRCTAEVENKYQLVKELLSTDYPENKSLKTSEKDVALIKDFLDSVKSLESFVKILTGTGKESGKDELFYGSFTKWFDQLRYIDKLYDKVRNYITEKPYSLDKIKLSFDNPQFLGGWQHSKETDYSAQLFMKDGLYYLGVMDKETKREFKTQYNAPENDSDTMVKIEYNQIPNPGRVIQNLMLVDGKIVKKNGRKNADGVNVVLEELKNQYLPENINRIRKTESYKTTSDNFNKDNLKEYLVYYIARTKEYYCKYNFVFKSADEYGSFNEFVDDVNNQAYQITKVKVSEKQLLSLVEQGKLYLFQIYNKDFSEYSKGKKNLHTMYFQMLFDDRNLENLVYKLQGGAEMFYRPASIKTDSEFQHDANVEIIKRTCEDKVKDKDNPTDDEKAKYYSKFNYEIVKNKRFTKPQFSLHLTLAMNCNQPDHYWLNNSVRELLKKSNKNNIIGIDRGERNLIYVTIINSDGVIVDQINFNIIENSYNGKKYKTDYQKKLNIREKERQEARKTWKTIETIKELKDGYISQVVHQICKLIVQYDAIVVMENLNGGFKRGRTKVEKQVYQKFETMLINKLNYYVDKGTDYKECGGLLKAYQLTNKFETFERIGKQSGIIFYVDPYLTSKIDPVTGFANLLYPKYETIPKTHNFISNIDDIRYNRSEDYFEFDVDYDKFPQGSYNYRKKWTICSYGNRIQYCKDSRNKPASRVVNITEKFKETFNNAGIDFVNDNIKEKLLLVNSKELLKSFMDTLKLTVQLRNSEINSDVDYIISPVKDRNGNFYYSENYKKSNEEVPTQPQDGDANGAYNIARKGLMIINKLKNTDDVTNNELLKISKKEWLEFAQKGDLGE

SEQ ID NO: 197 - protein, 1261 aa, unidentified
MKSLNQFIGLYPLSKTLRFKLIPVGKTKETFYASGILNRDRKRADDYPAVKQLIDECHKYLINESLRVENANLDWNPLQDAIMAYRREKSDENKKNLETIQGKMRSKIFEMLKKGACYADLTAATPDNLLKNKKLLDTILPDNSNGKSEIKSFTGFATYFLGFQENRRNIYTDEAISTGVPYRTIHDNFPKFLTNIEVYNTIKEVCPEVLIEAEKELLPFLDGVCLDDVFSVGFYNSLLNQNGIDYFNQILGGVTLEEGEKKLRGINEFVNLYRQQHPEVKTKKRGLTMVPLFKQILSDRETFSFIPQTIGSDQELVDIIKAFHENITHMEVDGEKENVIEKLCSLLSSIKEYNAEHIYINAKSITTLSQNVCKSWSHINDCLKRQAVEIYGTNTKSALKQVDSYLKRDAYSLTELSCVDADLTSYFTECADMQKEITDKFALFADNVTTDTHGDIKNDAIRTELTRKLLDAYMKLLHTAEIVAVSEELDIDKSFYTTFSRYYEALRAIIPLYTKVRNYLTQKPYNEEKFKLNFDAPSLAKGWDKNKEKHNKAILLFKDGVSYLAITAPSANVKWDELNRATKDGYSKMVYKQIAEPKRDLPHVIFSKKGKVTYHPSDYIVKGKEKGRYKKGKNFSKKFLHDLIDFYKACISQHPDWKNFGFVFSPTNSYEDISAFYNDISMQGYKLSFVDIPTSDINRLVDEGKIFLFQIYNKDYAEGATGTKNLHTLYWENLFSKENIENLVLKLNGEAELFYRMESVKKPVVHKVGEKMVNKRCKMDGSVMSGMPIPDNIYQELYRFYNGKMTEGDLSQEAKGYLGHVAVKDVTHEIIKDRRYTQPHFQFHVPLTINFRASGNDRVNEMVNEYLKNNPDVNIIGLDRGERHLIYLSLINQKGEILKQKTFNIVNQMDYQAKLAQREKERDEARKSWKSVGKIKELKEGYLSAVIHEITTMMVEYNAIVVMEDLNFGFKRGRFKIERQVYQKFEKMLIDKLNYLPFKDRKADQPGGILRGYQLTEKFVSFQRMGKQSGFLFYIPAAYTSKIDPVSGFVNIFDFNDVTNAESRKEFFENFDKIRFISENDGFEFTFNYDNERFKTHQTDYTKVWTVSTRGKRIVMQDDNGHKKPTDYYPTDALIEAFGKVGITLKPGMDVMAEIRKIKASNQTAAFFSELLFAFKSTLQMRNSNPLTGEDYIISPVQVAGKYYCSKEEAEKGPDATLPTDADANGAYHVALKGLFTIMYPGTKIEHAKWLEFMQTKPYKW

SEQ ID NO: 198 - protein, 1254 aa, unidentified
MYFGTGGIFDVIKIGGNIMKKISNMIEIFKVQKTLRFGAKPEGKTGEYIIQNGILERDRKRSKDYKVLKFYLDECHRDFIDKALNNIELEELREYAELFFQSPKDNKNKMKQLEDKMRKQICEHFKESGKKKLLSKSVLTEVLPEYFAEKGVEIPDEVNNFKGFFTSRRGLCLNRENMYASEPKHTAVAYRCINENLPKFLRNIECFDKIKKVIAKEELDEISNKINFEPYRIEDCFSGDFYNLCLSQKGIDMYNTFMGGYSKEDGTKIQGLNEIVNLYNQKIKNNREKHKLPQITPLYKQILSDSVSKSFSLDKYDCAADVIKAVRESYMGDTLERIGKIFNEFDEYDTSGIYIKNGTAITTISNAISDNWMLFRDNWNSEYDSKKKRSKIKDIEKYEENRNKTYKKIDSFSIDEIAGLLNKNVEDLIKYYQCNINELFKSITESYTIFKSVFDSKEVDEDDYEFSEKEIEEIKTYLDGVKKLESLLKQFMLNGKENNIDYVFYGDFIPAFDRICEIDSIYNKVRNYITSTRKPYKSDKYRLYFDNPQMLEGWDINKENARKTSMLLKDGQYYFAIINDKKSPFDNIPDEYVEDRDYYKKMIYKQIPNAAKYISGKNIKNPPLEILEILKKRKKDSKSLTEDEKNRFIDYVKTDFLVNYEPIIDKNGNRYFDFKFKNAEEYPTLEDFFEDVNRQAYSIRFEKISTRYINELVENGQIYLFRIYSKDFSEYSKGNKNLHTMYFEALFDEDNLENQIMKLNGGAEFFIRPASISKDKLIVHNKGQKLDNKNPLNSKKQSVFNYDLIKDKRFTEDQYMLHVSIDINKNAMEAENVQTINERVRKELKECDDNYIIGIDRGERNLIYICVINGNGEIVEQMSLNNIINEYNSVQHTTDYHKLLSKCEAERDKQRKSWKSIENIKELKDGYLSQVVHKICQLVEKYDAIIAMEDLNRGFVRNRLKFEKQVYQKFEKKLIDKLNYMVDKNKQEMENGGILKGYQLANSFNKDSSFQNGFVFYVPAWLTSKIDPTTGFVDFLKPKYVSVNESCEWINRFNSIKYDKSIDMFRFDIDYSNFTRADIDYKKKWTFYSNGDRIEEFRNPDTNNKNDYKVIKLSEEIKKLLESYNISYIGGDDIIPAIKCISDKGFWVNFIRYIKLTLQMRNNITGKTDVDYIISPVMNNMGNFYDSRQYDNEDSSLLPQNADANGAYNIARKALWAIDRIKEAEDDELKNVKIAISNKEWIEYAQTHFIKKEC

SEQ ID NO: 199 - protein, 1267 aa, unidentified
MKRLIDFTNIYQRSKTLRFRLEPIGKTADYIKNYQYLETDERLAKESKKVKELADEYHKEFIGDVLSSLELPLSKINELWDIYMSNDTDREIKFKKLQENLRKVIAEAFSKDKRFGNLFKKEIITDILPKFLQDKDDDIKIVNRFKGFTTYFYAFHKNRENMYVSEEKSTAIPYRIVNQNLVKYFDNYKTFKEKVMPLLKDKNIVESIERDFKDILNEKSIEDVFGLANFTHTLCQADIEKYNTLIGGLVVKNEKKEIKGINQYINEHNQTSKKGNGIPKLKPLFNQILSDRKSLSFTLDDIKKTSEAIRTIKDEYENLRDKLATIERLIKSIKEYDLAGIYIKMGEDTSTISQHWFGAYYKIIEAIADAWERRNPKKNRESKAYSKYVSSLKSISLQEIDDLKIGEPIENYFATFGTTCSDRTSGVSSLNRIKAAYTEFVNKFPEGFEDGDDCNDAYFKANVEVVKNLLDSIKDFQRFVKPLLGNEDERDKDEAFYGEFVPTYTDMDNIITPLYNRVRNFATKKPYSTDKIKINFENVVLLKGWDKNKESDYASIILMKDGQYFLGVLRNGSKSTLKTILPNTGDCYQKMVYKYFKDIKSNLPRCTTQRKDVKAHFAESSDDYSLLDTKTFVSALTISREVFELYNAPDKEKKFKKEYLKNTNDSIGYANAVSVCKRFCLEFLKKYRSTAIYDLSDVETSVDSFDDLSSFYQEIDKRLYSISFENVSVDSVNELVDNGNMLLFRIANKDFSPNSKGRPNLHTIYWRMLFDPANLKDVVYQLNGNAEIFFRKASVTRTEPTHPANVAIKNKSEYNKQNKPYSTFKYGLIKDRRYTTDQFEFHVPITMNFKQPESSKLQDKLNKQVLDFLKQDGVRHIIGIDRGERNLLYLVMIDMEGKIKKQISLNEIAGNPKNPEFKQDFHALLHEREGDRLESRRSWNTIQSIKELKEGYMSLVVHEIANMMLENDAIVVLENLNRSFMQKRGGIEKSVYQKFEKMLIDKLGYIVDKTKDVSDNGGALHAVQLADTFENFNKTQKGAIRQCGFIFYIPAWRTSKIDPVTGFVPMLRCQYESIVESKKFFGKFDSIYYDATGKYFVFQTDFTKFNTESKGGIQKWDICTYGDRIYTPRTKDRNNNPVSERVNLTEKMKSLFVSHNINIQGDIKAGIMQQTDKEFFESLHRLLRLTLQIRNSKKSTGKDYEDYIISPVMGKDGRFFDSRNADATQPKDADANGAYNIARKGLMLLRQIQTQEKQDLSNGKWLEFAQR

SEQ ID NO: 200 - protein, 1258 aa, unidentified
MNKNLCVFNETIRSKSLSKTLRNSLVPVLNTQENIEKNGIIIEDELRAEKRLELKEIMDDYYRYYIEKKLNNIRKIDWSPLFQAIEKNVKNNTAKNQKELEEIQKEKRAELYGILKEDEDFKKMFGAKLVSDILPDFIKSTVSNADEIQKKLDIVKLFNRFMSSFTDYFENRKNVFSKEEKSTSICYRVVNDNAWIFYQNLVAYSKIKEDAPDEIDKINENEQTLGEYRIKDIFNYDFYCLLMTQSGIQFYNDVCGVVNSHMNLLCQKDKLNKGKYKMRKLHKQILSIAESNFEVPHMFQSDKEVYDTINTFIKDINDKNVLEKTIELSEKYNEYDLNRIYISNKYFESVSIFMCENWRTLNDAINYYYENNISGKGESKKKKVEKALKGEKCRSLKSINNIIEQYDVKAKKREAEEYIKSIVDKIGNLKISEMTYDEQISLIESEQKAEELKEVLDSLLDILHWTKVFIIEEEVEKDNDFYSELEEISDVLEPLTTIYNRIRNYITQKPYSEEKFKLNFGTPTLANGWSKSKEYDNNAIILIRENKYYLGIFNAKNKPDKKVMEGKKESENKTDYKKMIYMLLPGANKMLPKVFLSKKGIQNFKPSQEILEGYNQKRHIKSNEDFDIEYLHNLIDFFKESIQKHPEWNKFNFSFKETTAYNDISEFYRDVEAQGYKIEWTYISEQNINEMVENNQMYLFQIYNKDFAKESKGTNNLHTMYLKNLFSEENLRDIVLKLNGEAELFYRKSSIKHPIVHKKGSILLNKTYIDKDDKENKKSIPEKEYQEIYRHLNGIGSGELSDTAKEYLKKADYHEASKDIIKDYRYTVDKYFIHLPMTINYKSTDFISVNDIALKYIANRDDMHIIGIDRGERNLVYVSVIDMHGNIIKQKNYNIVNGVDYKSKLKDRENARDKARKDWKEIGKIKELKEGYLSLVVHEIAEMMVEYNAIIVMEDLNNGFKRGRFKVERQVYQKFETMLINKLNYLVDKNKKVDEDGGLLRGYQLTYVPKKLEELGRQCGFIFYVPAAYTSKIDPTTGFVNIFKDVAMNDVEFITKFDSIKYDNVRNMFALKFDYKNFVTHNVTMPKNEWTIYTNGSRIRREYSNGKWNKTREVWLTEEMIEVLDSYRIDYMEGQDVLEQIMNLDDREIKAVCKEVKNLIKLITQMRNSKSDNEDPDYDKIVSPVLNDDNKFFDSSDNSNGKYPENADANGAYCIALKGLYEVKKIRENWSDLMDFPRETLKIKHYDWFDFIQNKRYL

SEQ ID NO: 201 - protein, 1260 aa, unidentified
MNKNETIFSETIGQTYVSKTLKNTMIPIGATQLNIEKNGLITEDKIRSEKRQELKEIMDDYYRYFISNMLSGNLAKTIEWGELFDAIDNNYINNSDKTKNELENIQMKKRTELNKLFKSNDDYKKMFNAKLLSDILPEFINKQKISNTEKEERLNTVNLFNKFTSSFTDFFTNRENIFADDKSTSICYRIVNENAWIFYQNYLIYNKIKEDAEKEIITIENNNVDGLDGFTLNSIFNFDFYGMLINQKGIRFYNDICGIVNAHMNLYCQKYKKKAAKYRLKRMHKQILSIDESTFEVPKMLESDKEVYDLVNGFLYKLNEKKVLDRIRKISEDVTSYDLNKIYVCEKNYENLSLFMCRNWSILRDSIKAFYQENTTGSSAGKEKKIEKLMKEDKYRSLQNINELINKYNSNSIERKAEEYIVNINEKLENKELVQLTNNEDISLIEDEESGEELKRVLDLIMSINHWIKMFIIDEEVDKDMAFYTEIEDIYYELEPLKSIYDKVRNYITQKPYSKEKIKLNFGIPTLASGWSKTKEYDNNAIILIRENKYYIGIFNAKNKPDKTVIEGHKKKSDSDYKKMVYMFLPKPYLMLPKAFLSKKGIATYKTSEYILDGYKKKKHIKSSKNFDVNYCRDLIDYFKECINKRDEWKGYKFKFSETSTYEDINDFYKEIEKQAYTIQWTYIDEKDIDEMNEKGQLYLFQIYNKDFSEKSTGTKNLHTMYFENLFSEENLKNIVLKLDGNAEVFFRKSSIKQPIIHKKGSILVNKGYNEQKENEERKTIPDEVYTELYKYFNKIGEVKLSNEAKKLIDEGKVEYFTSDYDIVKDYRYTVDKYFLHLPIKINCNAENYSPVNDIALKNIAENNDMHIIGIDRGERNLIYVSVIDLHGNIIEQKNFNIINGVNYKEKLKQRESERDSARKNWKQIGKIKDIKEGYLSLVIHEITSLVLKYNAIIAMEDLNMGFKRGRFKVERQVYQKFENMLISKLNYLVDKNKAVNEEGGVLKGYQMTYIPKSLKELGRQCGYIFYVPAAYTSKIDPTTGFVSVFNYKEMDDEKFVTSFDSIKYDKNRQKFALKFDYTNFITHNVKLAKNEWTIYSNGTRKIRKYRNGKWNSPDNVNLTNEIIKLMEQYKIQYDNEQDILEQVETLETKNKNNFCKEMKKLVKYIVQMRNSLPDNDSIEYDEIISPVLNEAGEFYNSEEKNKKLPLDADANGAYCIALKGLYEVKQIKNNWKEDEKFPRKTLKISHNDWFDFIQNKRYL

SEQ ID NO: 202 - protein, 1264 aa, unidentified
MNIKFNKFTGVKPVSKTLRNALIPTEFTMANLERNGIISADELRAEKRQELKKIMDDYYRDLIERTLAENHSINWHILFELMKSKMHGDEKDTAKKLENEQKSKREEIHRLFAEQEEFGKIFSAKLVSDILPGFVASYAMYNDEDRTEKAEVVKLFNKFMSSFTEFFENRKNVFSKENISTSLCHRIVNDNALIFLNNMDSYKRIMENFKSESELVSKGLETMLGEWKISQIYSEDFFGMTMTQSGIEFYNDICGELNLVLNLYCQKSKKNSARFKMKRLHKQILCTEKSSFEISYKYDNDKDVYTSVNGFIKNIKNNNIIERLLKLGTETEQYDLNKIYISSQSYETVSIAIGGTWETIRNCLTSWYDDNIKGSGRAKENKIKAVVKADKYQSIARVDYLTETYNASGTDLQKAESYLSHIVQIIGDYEPEELYFDESIHLIENGDKISEIKKILDIYIDVVHWIKTFEISESVEKEPEFYYELDDIYDKILDAVPLYNKVRNYVTQKPYNQEKFKLNFDSPTLANGWSKSKERDNNAIILSRDGKYYIGVFNVRNKPDKEILEGHSKPKNETDYAKMVYNLLPGASKMLPKVFLSKKGIDNFKPSDYILEGYIKKKHIKSSETFDIKYCRDLIDYFKNSISRHPEWKNFGFNFTETSKYNDISEFYKEVEKQGYKIEWTYITEEDINKLDEAGQIYLFQIFNKDFAVGSKGTPNLHTLYLKNLFSKENLDNVVLKLNGEAELFFRRSSIKTPVIHKKGSILVNRCYVDADDGKRKPIPEKEYMEIYNYCNGKRDTELSESARKYYNISQRYEATMDIVKDYRYSVDKLFIHLPITINFKATENKNVNDMVLEYIAKSDDIHIIGIDRGERNLIYVSVIDMHGHIVMQKSYNVVNEYDYKTKLKECEQGRDAARKNWKEIGKIKELKEGYLSMVIHEITQLIIEYNAIVMMEDLNFGFKRGRFKVERQVYQKFENMLINKLNYLVDKHKAVDEPGGLLNGYQLTYIPDRMSELGRQCGIIFYVPAAYTSKIDPTTGFFNAFRFNLLTSAESRRDFLNRFKCIKYNGSMNMFEFDFDYNDFITHNTTIARTQWKVFTNGGRIKNIISKSGWNGTKKIDDITALMKEIFDSRKIDFSDVGNLLPEILAYEGADKDKFIVELLDIFKLTVQLRNSMPDGSDIEYDRIISPVINENNTFYDSDMYTEPNSPLPIDADANGAYCIALKGLYEVNQIKENWKDGETFPKSVLKLNNANWFDFVQNKRYE

SEQ ID NO: 203 - protein, 1196 aa, unidentified
MYFENLTKQYELSKTLRFNLIPQGKTLENIKNDNIIEADKFRKENAVVVKKLFDKVHNEVINSTLEKGNILGDIGYVADLYFKPSKNIEERQMLDEAFSALRECISKALKEHKLYKELSGTKIFKYAAKDTALTEEEYNILQSFNGFTSYFTNYNDVRATLYSDEAIAGSVANRAVNDNLPRFFDNISVFSLLDGQLSDIPDINDYFTVGMYEQFLSQKGIDAYNEMIGKLNMRINLINNSNKKNNINKKFPKLKELYKQLLSDKKTLFIDMIESDEEAIERLHNFEEEFMPFVSGEAFNSFYNDLYASGGTGVYVKNDVSLTSLSVMIFSKWNEINDMLIDRYDSSYTGKKKKYEDKYIEERKKQLDKYKSYDLASVQALADDKNINILNCYVDKINEDISNIKTSRKLLDNVLYVEHIREKKLAKNLKAVDAIKTYLDYIKTLERDLKLLSGTGDEDNRDIFVYNSLELILSNVTKVDSIYNLMRNYLTKKPFSEEKIKLNFNNPCLLAGWDINKESDYCGIMLLKDDNYYLGILASGCRSAFKNLKACESSEPYYEKMVLKQIPSSAKYLSSKQIYPQNPPEEIVRILEKKKKDSKSLDKTEISTLIDYLQNNFLKNYSMLIDENGENYFNFSFKKPEEYNTLNEFFIDVDRQAYSVKTKKIPEEYINKLVDEGKLYLFKIYSKDFSEYSKGNLNLHTIYFKMLFDERNLKNPVYQINGGAEVFYRPASIDSQDMIVHKAHQPVQNKNINNEKKESIFDYDIIKNKRYTKDQFLLHIPVTMNFGAGKIYNYNNIVNKCISADPDVCVIGINRGERNLLYVSVVDKSGRILEQKSLNVINNTDYYSLLLDRENERNNARKDWKNITDIKNLKEGYLSLAVNEIVKLIFKYNAVVVLEDLNMAFKNSRQKIERNIYQKFEKMLITKLNYLVVDKSREQTEALNTGGALNALQLTSQFESFNRIGKQTGCIYYVPARYIGRTDTTSGFVNLLPNLRYENVTKSQEFFNKFDVCYNSQADEFEFQFDYNDFTDKAKGTKTDWTLSSYGDRIVKFKNESTGSWDEEVVDITSELKSLFDEYGIDYISGNNFINDIIKLENRDFFLRLTKLFNLMLQMKNISLDKTTDYFISPVRNRQGSFYDTRKHNNTLPDCADANDAYNIALKGLWAIDKVRSSEDRVNLVMSDKEWLTYIQSNLI

SEQ ID NO: 204 - protein, 1288 aa, unidentified
MNNEHYYEEGFTNSTSVTKTLANELRPTYWTCKHIRDNGILLMDELRNKETDELKSIMDDYYRKYIDDKLSCVHSLNWKELFAALDKMFKEEKSGDAIREYIEKERTLMRDKLYKLLSDDEKFKLMFTGKFVTKILPEFVRNNDAYDEEQKEKKLNTLELFGEFTTAVGDFFNNRKNVFSKDAKHTAICYRVVDENFTIFYRNIVSYKKIVDNAPGEIEKIELENKNRLGEWQLSHIYTHEFYNEVLIQKGIEYYNDICGMINSHMNLYCQQTKEKSGQYRMRKLHKQILSTTSTSYEVPYMYKDDTEVYNSINLMVDKILTGNFSDKIKGMLEKSSEYDFNKIYVSSKKYGNISNFMCGTWSLVESCIRNYYEDNTVAKADKKQQKVEDRIKKEKYRSLHSIDKVVEMYDKEKVNRDAKDYIYYIEEIYDEKKLKKIEADNQIKLVEDDKKIENIKEMLDMLLNTKHFLGMFDIDDSEDLDIGFYSEIDGLIEVIDGVEKLYNRVRNYVTKKPYNKGKIRLNFNSPTLASGWSKSKEYASNAIILRREGKYYLAIFNVGNKPDKKIMEGYRGEVGDGYEKMVYSLLPGANKMLPKVFLSKKGIDKYKPSQYILDGYSKERHLKSSKNFDINFCHDLIDYFKKSINANEDWKVFDFKFSDTNSYEDIGGFYREVEEQGYKISWVNIARKDIEKLDEDGQIYLFQIYNKDFSDNSTGTPNLHTLYFKNLFSEENMKQTVLKLNGEAELFFRKAGIEKPIVHKKGSILVNKTYKTMVGNEEVRVPIPDKEYMELYTYFQNGETTSLSENAIKLLDSNAIEHFAATMDITKDRRFTADKFFIYTSIVINYKAKQITDRQLNEQVLDYISKQDDMHIIGIDRGERNLVYVSVIDMKGKIVEQKSYNIVNNYNFQKKLVEREKERDKARKSWKEVGKITDLKEGYLSLVVHEIADMVVKYNAIIAMEDLNYGFKRGRFKIERQVYQKFESMLIKKMNYLVDKKKKVNEPGGLLKGYQLTYIPKEIKKVGRQCGIIFYVPPAYTSKIDPATGFVNVFKFKSDNQGGGAKARNSKKEFLSKLDDIRYIDSDKYGEPLFSFTFDYDNFITHDTVLAKRKWTAYTFGSRIKKVFENGKYTRKSQEIKLTSEMRKILEENKIEYRDGHNLIEDIQKADDDVVDGIFNIFRLTVQMRNSMSEAENCEYDRLISPIMNSDGVFFDSFVYKNINEKSATSNNTASMPIDADANGAYCIAMKCLLEAKRIKLDWGKSSKNNNTLLIVTNADWFDFMQNKRYL

SEQ ID NO: 205 - protein, 1286 aa, unidentified
MSYNKEKMEEKELGKNQNFQKFIGVLPVTKTLRNELIPTETTKKNIAQLDLLTEDEIRAQNREKLKEMMDDYYRDVIDSTLRAGIAVDWSYLFSCMRNHLRENSKESKRELERTQDSIRSQIHDKFAERADFKDMLAAPIVTKLLPAYIKQKSKYSERYDECVGILKMYGKFTTSLKDYFKNRENIFSKEKKSTAVGYRIVEENAEIFQRNQNAYDRISKIAGLDIHELDNEIAAYVSGKTLKEVCSDEGFTKVITQEGIDRYNEAIGAVNQYMNLFCQKNKALKPGQFKMKRLHKQILCKGTTSFEIPKKFENDKQVFKSINSFTEIITKNNDLNRLLNIVQHVNDYDMKGIYVAADAYSTISQKISKKWNLIEECLMDYYSDSLPGKGKSKETKIQKAIEDEKYRSVSQLNELIEKYYVEKTGQSVWKVESYISSLAETIKQELCHEIENDEKRNLIEDDDKISKIKELLDMYMNVFHIIKAFRVNEVLNFDETFYSEMDEIYQDMQEIVPLYNHVRNYVTQKPYKQEKYRLYFHTPTLANGWSKSKEYDNNAIILVRDGKYYVGIFNTKSKPSKELIRGHLSESENDYKKMNYFLLQRPHMNLPHVFITANHDFYKPSKYILDNYKKGKQVKSNKNFDIQFCRDLIDYFKECIKKHPDWNKFNFEFSATETYEDISAFYREVEKQGYRVEWTYINSEDIQKLEEDGQLCLFQIYNKDFAVGSTGKPNLHTLYLKNLFSEKNLRDIVLKLNGEAEIFFRKSSVQKTVIHKRGSTLVNRTYEITENGTTRVQSIPESEYMELYRYFNSGKQIELSDEAKKYLNKVQCNTAKTDIVKDYRYTMDKFFINLPITINFKVDKGNNVNAIAQQYIAERKDLHVIGIDRGERNLIYVSVIDMHGNIVEQKSFNLVEQISSQGVTRYYDYKEKLQNREEERDKARKSWKTIGKIKELKEGYLSSVIHEIAQMVVKYNAIIAMEDLNYGFKRGRFKVERQVYQKFETMLISKLNYLADKSLAVDEPGGILRGYQMTYVPDNFKNVGRQCGIIFYVPAAYTSKIDPTTGFINAFKRDVVSTNDAKENFLMKFDSIQYDREKGLFKFSFDYKNFATHKLTLAKTKWDVYTNGTRIQKVKVEGHWLSREVELTTKMKELLDDSHIPYEEGQNILDDLREMKDITTVVNGILEIFWLTVQLRNSRTDNPDYDRIISPVLNHKGEFFDSDQYKAYADAQKAPLPIDADANGAYCIALKGMYTANQIKENWVEGEKLPADCLKIEHARWLAFMQGERG

SEQ ID NO: 206 - protein, 1314 aa, unidentified
MLRYFFYKYHKQRIHNFIKMKGAKMGYENFINKNSCVKTLVNELRPTEWTRKHIEEDGILSADELRAEESDKLKSIMDDYYRRYIYTKLSGVNSLDWDELFSIMEVAYKSGKKDKNCKAQLEKVQEEMRGKFYNVLSDDEIFKMMFSGKFVTKVLPEFVRNNKEYSAEEKQQKLDTLKLFKGFTTSLVPFFNNRENIFSKKPIHSSICHRTVDENTAIFYQNIISYKNIEDNAPQEIEKIEHQGRQQLDEWKLPDIYSYSFYNNVLTQQGIEFYNDICGSVNSHMNLYCQQMKEKSGQYRMRKLYKQILSISSTSYEVPYKYEDDAQVYSSINEFVDRIFNSNFSAKVEKMLGKAEEYDFDKIYISSKNYSSISNFISGKWNTLDDCIRRYYEDNTVGNGDKKEKKVEEKVKKDSFRSLDSIDKVVEMYEKRGKSAKEYIYQIREIYNDNRLDKFGQDGSDTVKLIENDAKIERIKCVLDMLLNTNRFLDTFAVGDGEAVDVGFYSEIDELKEIIDGIDPLYNRVRNYVTRKPYNKNKIKLNFNSPTLAEGWSKSKEYEDNAIILRRDGKYYLGIFNVKNKPDKKIMEGYSGDVGDGYEKMVYSLLPGAGKMLPKVFLSKKGIGNYKPSSYIIDGYDNDRHIKSSKNFDINFCHDLIDYFKSSISANPDWKVFDFKFSDTKSYEDISGFYSEVEKQGYKISWVNISKEDIDRLDETGQIYLFQIYNKDFSESSMGTPNLHTLYFKNLFSEENIRETVLKLSGKGELFFRKASIDKPSGHRKGSILVNKTYKTNIGNEEVRVPIPDKEYMEIYTYLNNGRTTKLSENAQSLLDNKLVEYFEAEKEIIKDRRYTVDKFFIHTSVVINYNAEGASDKQLNEQVLEYISKQDDMHIIGIDRGERNLVYVSVIDMKGRIVEQKSYNVVNSYSYQKKLVEREKARDEARKSWKEVGRIKDLKDGYLSLVVHEIADMVIKYNAIIAMEDLNYGFKRGRFKIERQVYQKFESMLISKLSYLVDKTKMADEPGGVLKGYQLAFVPKDVKKVGRQCGIIFYVPPAYTSKIDPATGFVDLFKFKSGEKEGTARADNDRKEFLSKFDDIRYVEKNDNREEMFAFTFDYDNFAMHNTVIAKKKWTAYTFGSRIQKVYENGRYTSSTREIQLTDKMKRLLNENNIEYGDGHNLVDDIRTLDVDSSGAVINEIFKIFRLTVQLRNSKSEAENEKNGEYDRIISPIMNDAGEFFDSFKYKKMNEETEPGKHNATMPIDADANGAYCIAMKCLYEAKNIKSGWEKEGKKNNDLLCVTNADWFDFMQNKRYV

SEQ ID NO: 207 - protein, 1288 aa, unidentified
MVGNKISNSFDSFTGINALSKTLRNELIPSDYTKRHIAESDFIAADTNKNEDQYVAKEMMDDYYRDFISKVLDNLHDIEWKNLFELMHKAKIDKSDATSKELIKIQDMLRKKIGKKFSQDPKYKVMLSAGMITKILPKYILEKYENDREDRLEAIKRFYGFTVYFKEFWASRQNVFSDKAIASSISYRIIHENAKIYMDNLDAYNRIKQIACEEIEKIEEEAYVFLQGDQLDVVYTEEAYGRFISQSGIDLYNNICGVINAHMNLYCQSKKCSRSKFKMQKLHKQILCKAETGFEIPLGFQDDVQVINAINSFNALIKEKNIISRLRTIGKSISLYDVNKIYISSKAFENVSVYIDHKWDVIASSLYKYFSEIVKGNKDNREEKIQKEIKKVKSCSLGDLQRLVNSYYKIDSTCLEHEVTEFVTKIIDEIDNFQITDFKFNDKISLIQNEQIVMDIKTYLDKYMSIYHWMKSFVIDELVDKDMEFYSELDELNEDMSEIVNLYNKVRNYVTQKPYSQEKIKLNFGSPTLADGWSKSKEFDNNAIILIRDEKIYLAIFNPRNKPAKTVISGHDVCNSETDYKKMNYYLLPGASKTLPHVFIKSRLWNESHGIPDEILRGYELGKHLKSSVNFDVEFCWKLIDYYKECISCYPNYKAYNFKFADTESYNDISEFYREVECQGYKIDWTYISSEDVEQLDRDGQIYLFQIYNKDFAPNSKGMDNLHTKYLKNIFSEDNLKNIVIKLNGEAELFYRKSSVKKKVEHKKGTILVNKTYKVEDNTENSKEKRVIIESVPDDCYMELVDYWRNGGIGILSDKAVQYKDKVSHYEATMDIVKDRRYTVDKFFIHLPITINFKADGRININEKVLKYIAENDELHVIGIDRGERNLLYVSVINKKGKIVEQKSFNMIESYETVTNIVRRYNYKDKLVNKESARTDARKNWKEIGKIKEIKEGYLSQVIHEISKMVLKYNAIIVMEDLNYGFKRGRFRVERQVYQKFENMLISKLAYLVDKSRKADEPGGVLRGYQLTYIPDSLEKLGSQCGIIFYVPAAYTSKIDPLTGFVNVFNFREYSNFETKLDFVRSLDSIRYDTEKRLFSISFDYDNFKTHNTTLAKTKWVIYLRGERIKKEHTSYGWKDDVWNVESRIKDLFDSSHMKYDDGHNLIEDILELESSVQKKLINELIEIIRLTVQLRNSKSERYDRTEAEYDRIVSPVMDENGRFYDSENYIFNEETELPKDADANGAYCIALKGLYNVIAIKNNWKEGEKFNRKLLSLNNYNWFDFIQNRRF

SEQ ID NO: 208 - protein, 1260 aa, unidentified
MRRFFMTKMTDFTKLYQLSHTLKFELRPIGKTSENLQNSGLLEEDFKRSQDYVEVKSVLDEVHKKFLQDVLSDCDLSWQELADALKIFQVNKDRKVLEDVQKKYRKLLADRFNKNKFFKTLTEATPSKLFKSLLAEPDMAERKVETFKRFACYFKGYQETRQNIYSAEAQQTAAAYRAVNENFVKYLRVVELYENFRKNFPELAEEIGRRTAELTNGELSQILRIENYNRFIAQSGIEYLNSLIAQINSAVNLYRQAHNVKLSFVPLLFKQILSDREQAFTLERIEKDADLDEKLRAFCERHIGNVEIRGETGDLFSRLKVLLTTLNDDCELYIDAASLSAIGNALTGNWSCFRDAMTAYANETLKNKSLREKYCKQPVYSFSEIKSWRVVRTDDDGNVQPVCLSDYWHGEKTLELFAAEKILRNRILEMVRVPHDKNFRERKNDVALVKDYLDAVVEILHLLKPLNVGSENGGDLDLLGILTEFYEALSPVIPLYNQIRNYVTQKPSDIGKIKLMFNNPTLADGWDLNKEKDNTAVIFCRNGMYYLGIMNPKSKTDFNSLATDSSTDSYQKMVYKQLQNPNQMLPKVFFSAEKIKFFAPSEELLRRYEAGEYKKGEKFDLAYCHELIDFFKRSIDRHEKWSKFEFKFSETSAYSGINEFYREVAEQGYKMSFVNIPVKAVDQLVEDGKLFLFQIWNKDFSEKSTGTPNKFTLYWKALFDRQNLSDVVFKLNGEAELFLREPAITEPVVHRPGGKLVNKTVVAAVDGNGVAIRNSIPDAVYTEIYKHVNGMEEGTLSPAAREHLNRFPRLDWEPGMGLEATVKRTVVKDVKFQLVKDKRFTERKFSFHVPITVNFKSPRLKGAKLNEMVWEFLKDNPDVNVIGIDRGERNLIYVNCIDLKGRILLQKSFNIVGGFDYHQKLDLRERERGQARKSWNEIGTIKELKAGYLSGVVYEIARLMVEYNAIVVMEDLNGGFKRSRTGIEKQIYQKFEKALIDKLNYLVFKNESDWHVPGGLLNGYQLTGPLESFAKLGKQCGWLFYVPAAYTSKIDPSTGFVSLFKLSNYTNTEKRKAFFENFESIVYQAEQDAFVFAFDYKKFKDVENCWKTSWEVYSARRRLVYSRRSRQIEEINPTRLIKRALDKRGVVLSDGFDLKHYITSVEAVNENAAFFKDIFDAFGTTLQMRNSSGEEDYIESPVLNENGQFFDSRKAGKEWPRDADSNGAYHIALKGLLRMKSGQTAKLKRLDWFEFVQRRGFITE

SEQ ID NO: 209 - protein, 1334 aa, unidentified
MRTIDEFCGQKNGYSLSKTLRNKLIPVGKTEDKIKEYHLMENDYGRAEAYVEVKNLIDDFHRSFIAERLDKVSLDWTNLFNALNEYQKNQKDKLLKAKCKKVLEAQQKEMRKKIVQLFTGDKDNKDPVYEKLFKKELIEDLLPEAIKKDTSGIITQKEEALAKFHQFCTYFTNFHENRKTIYSAEDKSTAISNRIVNENFPKYVANIKVFEYLSKNFPKIIDDTENQLKNDLSGKKLKDIFTINGFNNVLSQKGIDFYNIIIGGIPEKEGIPRKQGINEAINLLRQGLPPERKNELKQRMTFLYKQILSDKEKVSFIPEVFNDSKEVYLAVQAFNAKCISSIIDKIADLYKQHNAYNLEKIFVPAKSLTAFSQSVYGNWSLLSECIFEKEKGEKTLSEKKLEDLTKKIAKNDYSLIDLQSAYDIWADKNNIEFNKRISINSYFNLNEIRQQKRPDGTYEKVVSNLIEDVKSTYIRIDFDNIKDLQQEKNASIPIKEYLDAVQNLFHYLKLVDYKGDALKDEMFYSSYDEYLQILSEIMSLYNKTRNFVTKKVGEIKKIKLNFDCSSLLSGWGTDYGSKAAHIFKSDSCFYLGIINKKLDKTDIDSIYQNGNTMIEKIVYDFQKPDNKNTPRLFIRSKGNAYAPAVSTYDLPIESVIDIYDKGLFKTEYREKNLEVYKKSLIKLIDYFKLGFSRHDSYKHYNFCWKETKDYADISEFYADTMRSCYQLKTERINFDNLMTLVDEGKLFLFQIYNKDFSTGKDGGNGSTGRKNMHTLYWENLFSKENLDDVVLQLSGGAELFFRPKSLEEENATIHEKNSFIVNRTYLKEVKGNKEIYETIPEEIYQEIYQKLNGKTDTISDEAQELLSSGKVKYRAAPHRIIKDRHFTQDTYLFHCPISLNFKAQEITGKKFNDRVLEKIKNNSEIKIIGLDRGERNLIYLSLINQKGEIELQKTLNLVEQQKRLIDYQGKLVQKEGDRDKARKNWQTIGNIKELKEGYLSAVVHEIATLMVDNNAIVVMEDLNFGFKRGRFAVERQVYQKFEHMFIDKLNYLVFKDRKVTEPGGVLNAYQLTDKLEAFKDLGKQSGFLFYVPAGYTSKIDPATGFANLLDMTNLTNVQKKRDFFAKFDSICFDEEKQMFAFTFDYKNFPGKGSQEMSRTKWTVYSNGERIQFCGKGKASKHIENLTEEFKTLFREFDYQNGNNILDSILEVGAALKAGEKPAKEIADFWDKLLVLFKLVLQMRNSDAKTGDDYIISPVMSESGNFFDSREQEKLGNNAKLPKDADANGAYHIALKGLYLLKAFDKTPEDQLKKVDMKISNADWFRFAQEKEYNK

SEQ ID NO: 210 - protein, 1347 aa, unidentified
MKENLVDQMTSLYPTSKTIRFKLEPIGKTSENINKNGILSADECKAKDYLKIKETIDAYHKYFIDQQLRLVKTETINKQKTGTKFFLIDGVQNVYNIYNNLKKDRKDEKNRRLFLDKCTALRKKLVSEAFPSEVIKKLTSGKLFTDILPEWVAQENTTRSNEKKLFWSDTFKRFSTYFSGFHENRENMYSGEEKSTAIAYRLINENLPRFFDNVENFGKIQNTLKEWTSIFSDKEKQLFNEKTIKSTFVLENYANCLTQSDITCYNNLICGYTSENKEKVRGLNEFINLHNQKIKDKKEKLRSFKLLYKQILSDRETVSFIPYQFTSINKLYDAINNFYLVCIVNEKDDGGENCNVFEAIEKHFKKIKDGNYDLKHIYISHRSVSSISQKVFGRYSFIKDALEYYYCTDIRPKYEEEIQKAKPSKREKIEKELDNYVNQQYLPIELVDKACEKYSKTLEDNFKHSESSAITDYCAHFLTKIISSKTYSAGKYEDERYSCIKGELNTQHDENYHPSTEVVNNIKLFMDTILESIHRLRDFIIRRDEENICEKDEHFYEFIDKLWEKLSAFINLYDKTRNYLTGKPYSTDKIRLTFNIPALADGWDENKEKDCRAFIFKKSEQYYLGIAAKSGLHFVYNDKEHNLSSCYWKMIYKYFPDPSKMIPKCTITTKDVKTHFASSDDNYELFDPKKFVKPIIISKDIYDIYFNAGPKPAFTGEFIKNGGDQKEYKNALTKWIDFSKQFLSSYSSTAVYNFDSLRPSNSYQNISEFYSEIAALTYKINFKPILSKYIDDLVQKGDLYLFRITTKDFNSTHGMPNLHTLYWRSLFSEENLVKTCIKLNGQANIFYRVPSITSPVIHKKESILVGRTATNGKNIPEHIYTELCLIKNGKKAEKDADTETREYLTKIKIREAQYDIIKDRRFTQSTFLFHVPLTFNFGIKPSKTFEFNNKINDFLKKHDDVNIIGIDRGERHLLYVSVINRQGDILEQTTLNILNGVDYHSKLDNREKERAGARKNWGTIGRIADLKEGYLSIVIYTLVEMMIRYNAIIVMEDLNTGFKRGRFKVEKQVYQKFEKALITKLNYLCLKDIAIDKIGGILHGWQLTNPFESFKKMGHQNGIIFYIPAWNTSKIDPITGFVNVIKPKYTNRESANKFFENFKEISYKSKDDAFDFVYIDKFSGKNWIITTGGKVRYFWLKDPSGHGGSTQKVDITQKLKNCFTKNNIPWENGENIVETLTTSVNASVLKEVIWCLQRVLAMRNSSAEDGVDFILSPVRMPDGRTFCSNNAGEKLPCDADANGAYNIARKGILVMEKIKAGDKNPTLIKNEDWLNYAQSEVVVAMQMKKYK

SEQ ID NO: 211 - protein, 1280 aa, unidentified
MLYNGKNINKKIDYFTKQYNLQKSLKFALKPMGDTLKNFDLRNRLQIETDLNKKSKNVKDYINEFLAVKNDEALSKPISLSCLKEYSNEYFSEERNFDKMAKMEETLRKEIAKQISSVEKLLNKPKEFISKTLPQSITDTAKLDDINELSLFTSYFTNFITVKKNMYSSEDKALTIPSRSINDNLPKFLDNVSIFKIVRNNLDKDNLVELQNNFKGIYDTKIEDMFTVDYFNFVLSQSGIETYNNVIGGYSKPSGEKVKGLNEYINLYNQKASREDKLPLMKQLYKQIGSITDSISFIPAKFTSDEELLKAVYDFYNTTDQTLNIYSYVDIIDKFKDIIMNMDRGMYNLKGIFIKNDKNITNLSNGLLGNWSTIQNLWNDEYDKNNHPEKAKNIEKYEDKKKKAYQKNKSFSIFELQNLISTSNNEDINKKNITSYYIKEFIKLTTAVKDSYNVVKSTLTSYVITNKGLKTDNIAIAKIKSFLDSIKEVQYLLKSLFGKGKENSKDQIFYGEYLNWFNQLKTINKLYDKVRNYITAKPYSLEKIKLSFDNSTFLGGWQQSSETNYSAQLFTKDGLYYLGVMDKITKKEFKKAYNTPTDNNDTFLKINYNQIPTPGKQVQNLMIIDGETVKKNGRKNADGINTVLEELKNKYLPANINAIRKKGSFKTTSDTFNKADLTTFIEYYAQRTKEYYSQFSFVFKPYNEYKNFAEFIADINRQAYQIGYTEISKKQLFDLVSEGKLYLFEIYNKDFSNNSKGKPNLHTMYFKALFDKDNLSNIIYKLQGGAEMFYRPASIKMADRVIHPANQEIIKRSKEDFVIQKGGKYSLTEEERKDCYSILPYEVVKNKRFTKPQFSLHFSIALNCQCPDFNNINYDVRELLKKSGKTNIIGINRGERNLIYVTIINSEGKILRQENFNAISSNYKGSTYYTDYRNKLDNKEKDRKIARENWNTIEAIKNLKEGYISQVVHKICSLVTEYDAIIVMEKLNSSFKNSRAKIEKQVYQKFETMLINKLNYYVNKNISFKDYGGLYNAYQLTNKFESFEKIGNQSGFIFYVNPNYITNVDPVTGFANMLYVAYENINKAHSFIDKFDSIRYNQIEDYFEFGIDYEKFLNKKLNFKSKWTVCSYGNRIKFFRNKDKNNKQEYKTVSVTTELKNIFNNSGIDYLTGDIKDQLLNISDKTILKGFLETFKLILQIRNSNSKEDYIISPVKNNNGSFYCSKDYNCGNENVSELPKDIDSNGSYNIARKGLMLIQRINSATDVKDIKTSISKDEWFNFIQ

SEQ ID NO: 212 - protein, 1349 aa, unidentified
MDFSKFTHQYSLSKTLRFELKPVNETADYIEDYGSEYLKNLVKQDESRYDDYQQVKSLIDDLHRDYINRRLGFDGDGQLAHPRSVSDGSEALTVEDMDSAFEHYLKTKKTYKDIAELQAAKKQWTVYQTTLRKKLVTVFQDKADLFGKKLLSDFLPRFLQEQGSWGQHRELVKSFDKFSTYFSGFHENRKNMYVADDKATAIANRAINDNLPKFFENILVHQTIRDSEHASAINLEHSQQLLARFGVDSVSDVFTPGFYLKLFSQHGIDAFEELIGGIKADDSDAQHAESVVGINQNINQYRQQFNQTNSEAKLTRRSFPLMVRLHKQILATSNTTSFSYEPYTNDAGMLADLAKLVDEYDINEGFFSNLKQIMQQLKGADSSTIFIRSNALSQLSYAWLNNHAILPRAFAYHVEISSDFTTKVSKEKQLKLVDNSAKTKTVGLFSMADIEGWLAQLMASQDADSNALIIAAQQKKGTTLSHYFHQTFDAQLASMNKPFEQLLKELSVILNQSALDANRRPPQTNGVDDVGGQGFLQVVTIQQYMEASLNLLNVFKPLHLVFKRKEVEAPEQQDKGFYNEFSTLFTLMSDGLLTVYNKTRNHVTKKPYKSEKVKINFENPTLLLGWDANKEKSNSCVLFEKQGNYYLGVMHPKHRALFDYVIGMDELGKEKIVEKKNKLRESIITEAEGYRKVIYKLVPGVNKMLPKVFFSASRVGFFAPSEEIHRIRNTASFSKHGAPQKEHQKADFNLSDCHTLIDFYKTSIERHYEWRQFNFVFSPTSTYQDISQFYKELQDQAYRIEFDTINPTYIDQCVADGKLFLFQIYNKDFSPFSTGTKNLHTLYWLGLFEADNLKDVVLKLNGEAEIFFRRHSIKQKDAIVHQANKPIDRKNPAQAGQISQFKHDIVKDKRYTKDKFFFHVPITLNHKAKQSPRFNDAINQAVTTDTNVIGIDRGERHLLYYCVVSSHGDILAQGSLNTIKPSGGGTPVDYHHKLNAREKQRDAARKSWTNVENIKELKAGYLSQVVHKLTHLMVEHKAIVCLEDLNFGFKKGRFKVEKQVYQKFEKALIDKLNYWVDKKQNNISEPGHYLNALQLTEAFDSFEKMSRQSGALYYVRADYTSKICPLTGFVNLLKPYYQSVDKSQAFFAAFESIHFNGENVEFLFDYKKTNPSSKLTGSQTQWAVCSHGDRIVNKKNAQGVWGSETHFPTKIITDAFESVGIDYRAGGNVKSLILAKDTKAFFKDLLWGLRLTLQMRNSKPNSTLPEDDYLISPVTNNQGCYYDSRSAPATMPQDADANGAYHIALKGLWNIQQVTEHDWSDEKAKSPNLTMTNEQWFAFAQHKPFKKAD

SEQ ID NO: 213 - protein, 1302 aa, unidentified
MSNFNEFTHLYQLSKTLRFELKPIGETKENFSNSGLLKREEQKSTDYPKVKHLIDECHKFLINDALKVDKVKNLDWSSLQSAIKEYQKEKSDKNKKALENAQEKMRSKIFEILSKSEYYEELIASTPQKLLNDTELLKEVIGEAYDENTELKTFNGFATYFKGFQENRKNIYSSNAISTAVPFRSVHENFPKFLANIEIYNNINETCLEVLVDAEKELQPFLDSMSLSDIFSIDFYNRLLSQNGIDYFNQILGGVTQSEGKIKLRGINEFANLYLQKHPDVKVKKKALTMSPLFKQILSDRETLSFIPQTISSDQELVSIIKQFHESIISAEINGEKVNILECLCSLLCSIKEYDKERIYINSNYLTDISYSICNSWSYIGECLKVKATAKYGTATKIAIQKIDSYTKQTAYSLEELSCVNADLLPYFNKCSNMPQDIVGKYNCFCLNVASDKNTNLREDDIRIEFVKDLLDTYMNLLHISKAFVVPENLDLDRSFYAKFFVYYEYLRAIIPLHTKVRNYLTQKVYDDSKIKLTFDTPTLAAGWDKNKEKDNACIILRRNGLYYLGIIAKEHKKLLSPAMPSEGNCYEKMNYKQFDITKQLPKCTTETKKVKAAIAAGEESVTLDDAKKWNKPLVITTELWQLNNYVWDKNTMKWERRKKDNENRPKKFQKKYLEDTGDIDGYNKAKATWIDFAKTFLSSYKSTEIFNIKYEDSYDSVNKFYNQLDNELYNVSFTNVSASYIDELVKDGKMYLFQIYNKDYAKGSHGTKNLHTMYWEHLFSKENLANYVLKLNGEAELFYRKGSIKKPFSHKVGEKMLNKRDKSGMPIPDDIYKELYNYYNGKICKDKLSDNAMSKMNDVVVKEVSHEIIKDRRYTLPHFQFHVPITINFCAHNDLNINNQVLDYIKDEPNINIIGLDRGERNLIYLTLINQKGEILKQKTFNIVNQMNYQVKLSQREKERDNARKSWKSIGKIKELKEGFLSAVIHEITSMMVEYNAIVVMEELNYGFKRGRFKVERQVYQKFEKMLIDKLNYLSFKNVAVNKNGGILQGYQLSNKFESFKKLGKQSGFLFYIPAAYTSKIDPVSGFVNLFNFNDLTNTKAKKEFFSKFDDIKFISHEEGFKFTFDYNNFRTYQTDFTKRWTISTQGRRIIMREKDGHKQMVDYYPTKDIFDSLTNAGFIITPEMDIKAIIDTVEANKSSTHFFNTLLFAFKATLQMRNSNSETDFIISPICVDGKYYNSDIEAKKGKDEEGNWKSKLPVDADANGAYHIALKGLYTLIHPTEKIEHTNWFEFIQTKPYKK

SEQ ID NO: 214 - protein, 1262 aa, unidentified
MKTNKKIFTETIGTEVLSKTIRNALVPTETTKINIEKNGLITDDQFRAEKRASLKEIMDNYYRFYIEKKLSESNYISQIEWKDLFEAIEAKYKENNDKTKKELLKIQKEKRTEIYRIFYEDEDFKNIFSAKLISDILPNYIRSSELDEEKKEDVMQTINIFNNFTSSLSDFWNNRKNVFSPEDIHTSVCHRIVNDNAQIFYQNLLAFEKIKKDAFEEIKTIEDSNWDLIGEWKLIEIFNYDYYGMLMNQKGIRHYNDVCGVINMHMNLFCQKYKKNKAAYRMRRLHKQILSIDESTFTIPKMFENDEEVYKTINTFFETITEKKIIERVKNIADNYETFDDSKIYISNRYYETLSIFMTGNWKTVEDSLMAFYDKNIVTKSKAKDEKIKKAIKNDSYRSLSSLNDLVKEYNGDKLKNNADDFIKSIKEKIFQVEICKLEYTEKSNLIENEQEMLILKEKLDLLMEVYHWLKVFIIDEEIQKDNAFYLEVEDIYNELEPLISIYNKVRNYATQKPYKKEKIKLNFGIPTLAKGWSKSKEYDNNTIILLRDNKYYLAIFNPKNKPDKKKMEGHLNKEKATDYKKMVYRLLPGVNKMLPKVFLSKKGIAEYNPSNYILDGYELKKHVKSQNGFDINFCHDLIDYFKDCLNKHSEYRKFEFKFTNTEDYNDISEFYNEVEKQGYKIEWTYLSQEDVDTWEKNNSIYMFQIYNKDFSDKSKGKDSIHTMYLKNLFSEENLKDIVLKLDGEAELFFRKSSIQKPIVHKKGSILVNRTYKEGEERKQIKDNEYREIYNYLNNKNNEEISKEAMDLIKSKKVEYFVSDYDITKDYRYSVDQYFLHLPIKINFKSSKYSNVNEIALKNIAKSDDMHIVGIDRGERNLIYVSVIDLQGNIIEQKNFNIINGVNYKEKLRQREIERDRARKNWREVGKIKELKEGYLSLVVHEIAQLIVKYNAIVVMEDLNRGFKRGRFKVERQVYQKFENLLISKLHYLIDKNLEITEEGGLLRGYQMTYQPERLEQIGRQCGYIFYVPAAYTSKIDPTTGFVAIFDGKKMEDEKFVMSFKSIRYNKEKDMFAFEFDYRDFETHNVRLTKNEWRIFTNGKRLKREKINGKWGSVKKINLTNEMVEIMRAFNLNYLNGEEILLQIEKLDQTERKNICRKIKELVRYIVQMRNSLPDNEEDDYDEIISPVLNDDGEFFDSSNYKESARLPKDADANGAYCIALKGLYEVKQIKENWDKNQEFSREVLKIKHTDWFDFIQNKRYL

SEQ ID NO: 215 - protein, 1316 aa, unidentified
MNGTLFFYKYHKQRIHNFIKMKGAKMGYENFINKNSCVKTLVNELRPTEWTRKHIEEDAILSADELRAEESDKLKSIMDDYYRRYIYTKLSGVSSLDWDELFSIMEVAYKSGKKDKNCKAQLEKVQEEMRGKFYNVLSDDDIFKMMFSGKFVTKVLPEFVRNNKEYSAEEKQQKLDTLKLFKGFTTSLVPFFNNRENIFSKKPIHSSICHRTVDENTAIFYQNIISYKNIEDNAPQEIEKIEHQGRQQLDEWKLPDIYSYSFYNNVLTQQGIEFYNDICGIVNSHMNLYCQQTKEKSGQYRMRKLYKQILSISSTSYEVPYKYEDDAQVYSSINEFVDRIFNSNFSAKVEKMLGKAEEYDFDKIYISSKNYSSISNFISGKWNTLDDCIRRYYEDNTVGNGDKKEKKVEEKVKKDSFRSLDSIDKVVEMYEKRGKSAKEYIYQIREIYSDNKLYKFGQDGSDTVKLIENDAKIERIKCVLDMLLNTNRFLDTFAVGDGEAVDVGFYSEIDELKEIIDGIEPLYNRVRNYVTRKPYNKNKIKLNFNSPTLAEGWSKSKEYDDNAIILRRDGKYYLGIFNVKNKPDKKIMEGYSGDVGDGYEKMVYSLLSNIHSNFPRIFIKSDECEKKYKLSQYIIDGYDNDRHIKSSKNFDIKFCHDLIDYFKASINANPDWKVFDFKFSDTKSYEDISGFYSEVEKQGYKISWVNISKEDIDRLDETGQIYLFQIYNKDFSESSMGTPNLHTLYFKNLFSEENIRETVLKLSGKGELFFRKASIDNPSGHRKGSILVNKTYKADIGNEEVRVPVPDKEYMEIYTYLNNGRTTKLSENAQSLLDNKLVEYFEAEKEIIKDRRYTVDKFFIHTSVVINYNAEGASAKQLNEQVLDYISKQDDMHIIGIDRGERNLVYVSVIDMKGRIVEQKSYNVVNSYSYQKKLVEREKARDEARKSWKEVGRIKDLKDGYLSLVVHEIADMVIKYNAIIAMEDLNYGFKRGRFKIERQVYQKFESMLISKLSYLVDKTKKVDEPGGVLKGYQLAFVPKEVKKVGRQCGIIFYVPPAYTSKIDPATGFVDMFKFKSGEKEGTARADNDRKEFLSKFDCIRYVEKNDNREEMFAFTFDYDNFAMHNTVIAKKKWTAYTFGSRIQKVYENGRYTSSTREIQLTDKMKRLLNENNIEYGDGHNLVDDIRTLDVDSSGAVINEIFKIFRLTVQLRNSKSEAENEKNGEYDRIISPIMNDAGEFFDSFKYKKMNEETEPGKHNATMPIDADANGAYCIAMKCLYEAKNIKSGWEKEGKKNNDLLCVTNADWFDFMQNKRYV

SEQ ID NO: 216 - protein, 1266 aa, unidentified
MKVIDNFTKQYNVSKTLKCRLIPIGKTMENFQLNERLDKERNLNESVLNVKKYIMECLCNENDYLLSQPNQLSHLHEYSDLYYDEERDNNKLQKCEEELRKEVVSLISPIKKKLKKRKEFLTEYLPNVIGDDSKKEEILALSNYTTFFGDYLTNCDNMYSSEESSTAIANRCIGDNLPKFMDNMKIYENVISNLPSEYVNVLRENFVGIYNVNIDDMFTLDYFNCVLSQSGIDSYNMLIGGYVDESGNKIRGINEYISMYNAQNNGVRIPLMKALYKQIGSQNDVKSFLPLSFKDDKELLDAVYNYFNLDSEKDNVCSYFNTIKNISAIIANIKNYELDKIYVSNNVNIRNLSGGMLGKWNSFEQLWNKKYDDEKKPKKVKSIEKYEDKRKKEFKKVQSFSLNELQELIINYNDNHNHIPSVIDYYINKLQTMIGKVNHCYAKAKETLTIANKKLLKCDDNRIAKIKNLLDSVKDIEKFLRILQGTGKESTKDELFYGDYYENFNHIKAVDPLYNKVRNYITSKPYSKNKIKLSFDNPQFLEGWQNSLESQRSSQLFMKDGMYYLGVMDKNSRKEFKKPYNLPVDKDDKFTKIEYSQIAQPGKQIQNLMVIDGKTVKKNGKRNEEGINEVLEELKNTYLPADINKIRKKGSYKTTSKDFNQTDLIMYLEYYIERVREYYSQYNFEFKKATEYHSFVEFVDDVNRQAYQINMRDVSYKQVMQLVDEGKLYLFQLYNKDFSPHSKGKKDLHTLYFQMLFDKRNLTDVVYKLLGGAEMFYRPASIRKEDRVIHPKNQEIRKRTKEEYVAAKGGKGNLTPEERKQCFSMYKYDIIKNKRFTEGQFFLHFAISLNCQEADYKFLNYEVRNLLKTSNKTNIIGINRGERNLIYVTVIDSEGNIKEQENFNIITHSYNGLTYNVNYQDKLDKKEKNREQARENWTTLESIKELKEGYLSQVIYKICKLIVKYDAIVVMENLNSKFKNSRVRIEKQIYQKFENMLINKLNYYVDKDTDIDKCGGLLNAYQLTNKADTTTSSGSQNGIIFFVNPGYITNVDPTTGFISMINPKYENIKQVHSFIENIDDIRYNKDKDYFEFDIDFKKFPVKFQGGQSEWTVCTFGERLKYINNPLPGQKSYETLSMTSEFKELFDDCHIKYEDGNVKDSLLCIDSKPLLQRFMELLKLTLQISNVVYDRDYIISPVLNNNNEFYCSESYITDTNANIPCCVDSNGSYNLARKGLIFLNRIKEAKDVTEVSTYISNEEWLDYIQNN

SEQ ID NO: 217 - protein, 1302 aa, unidentified
MKNGKIKDENLKRDNFQSEQFTNTMQLVKTLANELIPTAWTKKHIEENGILSMDELRDEESDKLNSIMDDYYRRYIDTKLSGVQSLDWNELFSVMDMLYKAEKKNEADKEKLKKVKYDMRKKFYEVLSDDAAFKTMFAGEFIKSILPGFVKENEEYNDEEKKQKFETLKLFDGFTTTLTHFFENRKNTFSNEAIHSSICYRVVDENATIFYQNMVSYKNIVDNASQEIDKIEEEIRQHCGDRKMSHIYSPDFYNNVLVQQGIELYNDICGMVNRHMNLYCQQTKEKSGRYRMRKLHKQILSIASSSYEIPYKYEDDAQVYSSINELVDRIVSADFSTKLEKLLEKASEYDFDKIYIASKNYGSISSFISGKWNTVDNSIRRYYEDNTAGKGEKKEKKVDDKVKENTYRSLESIDKVVGIYEEGCKSAKEYIYHIREIYSDAKLVRFGQDSLDEIKLIENDAKIERIKHLLDMLLNTNRFLDMFYVEDGVEIDADFYSDIDELKDIIDGIEPLYNRVRNYVTRKPYSKDKIKLNFNSPTLAAGWSKSKEEVNNAIILRRDGKYYLAIFNVKNKPDKKIMEGYSGDVEDGYEKMVYSIIPKIRANFPRMFIKSNEAKKKYKPSQYIIDGYKNDKYKVGSNFDINFLHDLIDFFKACININPDWKVFDFKFSDTKSYSNINDFYNEVEKQGYRVSWVNISKEDIDRLDENGQIYLFQIYNKDFSENSTGTPNLHTMYFKNLFSEENMKEKVLKLNGNAELFFRKASIKNPIEHKKDSILVNKTYKTMIGNEEVRIPIPDDEYREIYNYLNNRSTAQLSENAQWFLDNDKVEYFKANKDITKDKRYTVDKYFIHTSITINYSSGNNRENELNKQVLDYISKQDDMHIIGIDRGERNLVYVSVIDLKGRIVEQKSYNIVNNYDYQKKLVEQENIRDKARKSWKEVGKVKDLKEGYLSMVIHEIAEMVIKYNAIIAMEDLNYGFKRGRFKIERQVYQKFENMLISKLNYLVDKTKKVDEPGGILKGYQLTFVPKDIKKVGRQCGIIFYVPPAYTSKIDPMTGFADVFRFPVNGKETSAKARNDRKEFLCKFDSIKYVEKVNGNEDMFAFTFDYDNFIMHNTVIARKKWTAYTFGSRIQKVYENGRYTSESEEKKLTEELKKLLDKNNIKYSDGHNLVDDIRAMDDEAGDAVIRGIYNIFRLTVQLRNSKSEKKNGDYDRLISSIMDENGEFFDSFRYKEIDEKSEENHRVADMPVDADANGAYCIAMKCLFGAKKIKHNFGKTDKKNSDLLSVSNADWFDFMQNKRYL

SEQ ID NO: 218 - protein, 1278 aa, unidentified
MNSLELFTGKYQRQLTLRNALIPIGATLENLKKHGIIAADEELEQKYQQAKAIIDDYHRYFIDSNLSRIALNWQELYEALLAFQHQRNDETKAQLEKTQTAYRKQLLKAFTEDENYKYLFKKELFTKVLPSYCADKEKLSVIDAFKNFFTYFSGFNENRANMYSTEPNSTAIGYRLIHENFPKFITDCEIFTVLRQYCPEVIAAAENSLRQAAIIEKDVDLADYFMPNSFNAFLTQKGIDKFKNIIGELNKNINLAIQQAESLKRSLRSRRAIKMFVLYKQILSQDDGRPFIDAFANNEQLLASLQDFKSRLTAPGGALAKAAQLFKARADYQTDKIYISGKEINSLSKALYGGSNWSTLREAVLTALQNEKEYKKLLKENDAAAIDRKLSKNYFSLNFLQNHADAQLSEKIIKYFLKQHRSVLKAISTAFVSNDNFKPAVKKLLDALLDYYRFAAIFKAEDSLEKDTEFYSIYDVAMEQLQETVYLYNKTRNYITKKPFNEEKFKLNFGNAQLAGGWDMNKETDYTSIILTKDGAYYLGIMNKNNKPQIANAITESTENIYRKMVYKYFPDFSKMFIKCAMTKEVKNHFQESSEDFILKTNSFVRPLIISRKIYDLYSTEYDGKKKFQIDYLRKTGDAQGYYEALKTWIDFALNFMRSYSSTSIYDIEQIKAAQYERLDTFYKDINNICYNISFVNLSAKKIEEWVNDGKLYLFQIYNKDFAPGHSGVKNLHTLYLESIFDEQNLKDVVVKLNGGAELFYRRKTKGAPSVHSKGSKLVNRTTADGLTIPEEIYQEIYLYANGKKESLSQQAQEYYPRAVIKTATHDIVKDRRYYEDKFFFHFPITINYKAPDSSGAFNQEVLAYLHHNRDVNIIGIDRGERNLIYITVINQQGQILASKSFNSIIQQTGTVNKTVDYHDKLAKREQERTEARKSWETIGKIATLKEGYLSAIIHEIAKYMIKYNAIIVMEDLNAGFKRMRGGIAEKAVYQKFEKMLIDKLNYLVFKKLSPSEPGGILKGYQLSSKFESFEKMGRQNGFLFYVPAAFTSKIDPVTGFSSVFKFKEYTANTEKAKSFFACFDSIVYNSQQDVFTFSFNYDNFKTYATMYRKNWQVCSAGERIQHEKNAAGYYTDRFVNPTHDIKKLLTLQNIDFGTEQNILPQLLQIESNKTTVSFWKGMLTAFQRIVQLRNSSKTLISGGKEADYIISPIADTKGNFYDSRTASAAWPQDADANGAYHIALKGLMYININNSAKNNKPKLYIKNEDWFKFVQERNIVK

SEQ ID NO: 219 - protein, 1278 aa, unidentified
MHNLELFTGKYQRQLTLRNALIPIGATLENLKKHGIITTDEELEKKYQEAKAIIDDYHRHFIDANLSRIALDWQELAEALLASQHNHNNETTEKLEKVQATYRKQLLKAFSDDENYKHLFKKELFTKVLPSYYTDKKQLAVINAFKNFFTYFSGFNENRANIYSTEPISTAIGYRLIHENFPKFIADCEVFTALQQYCPQVVNAAETVLRQLAIIEADTELADYFLPNSFNAFLTQEGISKFNNIIGELNKNINLAMQQDENLKRSLRSRRATKMYVLYKQILSEDDGTPFIDTFENDGQLLTALHDFNARIATPGGALEKTAQLFAALTEYQAEKIYISGKEINSLSKTLYGGSNWNTLREAILTALQDEKEYKKLLKENDEAAIDLKLSKNYFSLSFLQNHADKHLAEKINGCFQEQHELALQAVKPDALNTEKLKASVKKSLDVLLDYYRFISLFRAEDSLAKDPEFYSGYEEVLNKLKEIVYLYNKTRNYMTKKPFNEEKFKLNFGNAQLASGWDANKEADYTSIILTKDGAYYLGIMNKNRKPDIDAAITESTENTYRKMVYKYFPDFSKMFIKCTMVKEVKNHFQESSEDFILQTSTFIRPLKITREIYDLYSTEYDGKKKFQIDYLRKTGDAKGYYYALNKWISFALAFMRSYDSTSIYDISQIEATQYERLDTFYKDINNICYNISFVNLAADKVDEWVADGRLYLFKIYNKDFAPGSSGTKNLHTLYLESIFDEQNLKDVVIKLNGGAELFYRRKTKGTPAIHCKGSKMVNRTTADGQTIPEEIHQEIYLYANGKKETLSQQAQEYYPHAVIKTATHNIVKDRRYYEDKFFFHFPITINYKAADSAGAFNQDVLAYLHHNPDVNIIGIDRGERNLIYMTVINQQGQILDSKSFNGISQQAGVLSKTVDYHDKLEKREQERTEARKSWETIGKIATLKEGYLSAVIHEIAENMVKYNAIVVMEDLNAGFKRIRGGIAEKAVYQKFEKMLIDKLNYLVFKKLPASEPGGVLKGYQLSSKFESFEKMGKQNGFLFYVPAAFTSKIDPVTGFCSVFKFKEYHVNTEKAKIFFTGFDSIVYNTEQDVFTFCLNYENFKTYTNIYRKKWQVSSYGERIKHERNAAGHYIDSFVYPTRDIKELLTTQGIDYSNGQDILPQLLQIDDSKANSSFWKGMLSAFQRIVQLRNSSRTLTTDGKEADYIISPVADNTGSFYDSRTAAANLPQDADANGAYHIALKGLMYLNINNAAKDNKPKLYVKNEDWFKFTQERNSAK

SEQ ID NO: 220 - protein, 1356 aa, unidentified
MGEHIADKMTSLYSTSKTLRFRLEPIGETLNFIQKNAFLDKDKRKADDYVKIKVTIDEYHKAFIRDALSSVVREYEENQDLLNEGGKSDRKKISSEDFEELFTIYNNLKKDRSDEKNRTAFVHACKSLRQKIVKVAFPSDEIKELTSAKLFDKLPAWVAQENQKRSQDNKLFWTDTFKRFSSYFLGFHENRANMYSDEEKATAIAYRLVNENLPRFFDNIVIFNKIGHLFDDVKNSLTEKEKKLFSDYDFETVFSPEYYIHCLTQSDISRYNTLIGGYSTSDKEKVRGINEFINLHNQKIKDKKNKIQPLKILYKQILSDRETVSFLPQQFSTTDEVYTKIVDFYLSCILDLCIDEKNGCNAFQILAQQFRKIQDNVFNREQIYISHRALSSISKKIFRNPFFIHDALDDYYRTVSVPDYDKKLLSLKTKTNRENLEKELDEFINKQFLPISLIDKACDNYLHKLDGKEETCVSSSVSEYCAHLLEWEKVINNEPKVFAPGKYEEAVYCSIKGELNSQHDESYRPSSATVDKIKHFLDTLLASIRSIQDFIIPREKETLVEKDEAFYKVIDSVWEHLSSFSKLYDKARNFFSGKAYSTGKIRLTFGIPALADGWDENKESDCRALLFMKDEQYYLGIASKAGLKFDQFEKIPDGVPCYKKMVYKYFPGPTKMIPKCTVTTKDVKKHFKNETSDYILDDEKKYNSDLAISKYIYDLYSNSGSKPAFTDTYLKETNDTAGYKKALVEWIDFCKKFLKSYKSTADYNYDSLKESKDYTKINEFYNDVARLTYRIKFRKIPCDIIDSFVKSGKLYLFRITTKDFGCSHGHPNLHTLYWRALFSSANLNHTMIKLNGNANLFYRVSSIEEPTVHQKGSILVGRMTKDGKNIPEEIYLQVCQIANGKLDKKGVDEKVLKYFERSVQREAPYDIVKDRRYTKDVFLFHVPLTFNFGVESVKNINEKVNDFLKEHDDVNIIGIDRGERNLLYISVVDTKGQILEQKSLNILDGIDYHDKLDLREKERAKARESWGSIGRIADLKEGYLSFVIHYLTDLIIRYNAIVVMEDLNVGFKRGRFKVEKQVYQKFEKALITKLNYLSFKDFPAEEEGGVLHGWQLTNPFESFRSMGHQNGIIFYIPAWNTSKIDPVTGFVDKIKPKYTNREAAHSLFSKFTKISYCHEDDVFEFLWKDESSNKTWTITTVGKERYYWSRDSSQYGSVQKADVTEILKETFKNAEIEWENGEDLIPILTASDNASLLRTVTWCLRLVLSMRYSSEADKRDFILSPVRMPSGRTFCSETAPVSLPMDADANGAYNIARKGAIVLDRIREGGKNPTIIKNEDWLEYAQRDDIVALQESKYCE

SEQ ID NO: 221 - protein, 1347 aa, unidentified
MKEKIVDQMTSLYPTSKTIRFKLEPIGKTLDYINKNGILRSDECKAKDYLKIKETIDSYHKYFINKQLRLVKNKAIDEEKTGAKSSLTNDIQSIYNIYNDLKKDRKNEEKRKLFLDKCTALRKKLVREAFPSEFKKKLTSGKLFSEILPDWVAQENTTRSNEKKLFWSDTFKRFSTYFTAFHENRENMYSDEDKSTAIAYRLINENLPRFFDNIENFGKIQKALKEWTNVFTDKEKQLLNEKAIISIFALENYLNCITQDGITNYNNLISGYATENKEKVRGLNEFINIYNQKNNDKKEKLRSFKLLYKQILSDRETISFIPYKFDSINNLYDAINSYYLFNIVNSKDDEGKFCNIFEAIERHFQKIKQGKYNKKQIYISNRSVSSISQKIFGRYSFIKEALQYYYCTYVRPKYEEEIRKSKISKREKIEKDLENYVNQPYLSIELADTACKKYSEILDNNFKHFGNLTITNYCAHLLTKTISSKIYSAGKYEDERYSCIKGELNTPHEENYRPSTEMVNNIKLFMDSILESVHGFQDFIIRREDENICEKDDLFYEFIDKLWEKLSAFTKLYDKTRNYLTGKTYSTDKIRLTFNIPALADGWDENKEKNCRAFIFKKSEQYYLGIAAKTGLHFIYEDNEDSHYSYYYKMIYKYFPPSFTMIPKCTVKRDDVKNHFESNDADYKLFESKKFVKPIIISKDIYDIYFNKGPKPAFTEEFIKNGGDQIEYKNALIMWIDFCKQFLSAYASTAIYNFDSLRPSSNYKNINEFYSEVSALTYKIKFKPISSKYIDDLVQKGDLYLFRITTKDFNSTHGMPNLHTLYWRALFSEQNFAKTYIKLDGEANIFYRVSSITSPIVHKKGSILVGRTTTSGKNIPEHIYTELCLIKNGKKAEKDADAETREYLTKIKIREAQYDIIKDRRFTQNTFLFYVPLTFNFGKKTIKPFELNNKINDFLKKHDDVNIIGIDRGERHLLYVSVINRQGDILEQTTLNTLNGVDYHSKLDNREKERAGARKSWGTIGRIADLKEGYLSIVIHTLVDMMIRYNAIIVMEDLNMGFKRGRFKFEKQVYQKFEKALITKLNYLCLKNIAIDEIGGILHGWQLTNTFKSFKKIGHQNGIIFYIPAWNTSKIDPITGFVNVIKPKYTNRESANKFFKDFKEISYKSEDDAFDFVYTDKISGKNWIITTGGKVRYFWAKDSSGHGGSTQKVDITQKLKTCFNKNEIHWENGENLVTTLTKSVNASFLKEVIWCLQRVLAMRNSSAEDGVDFILSPVRMPDGRTFCSNNAGEKLPCDADANGAYNIARKGILVLERIKAGDKKPTSIKNEDWLNYAQSEAVVAMQMKKYK

SEQ ID NO: 222 - protein, 1356 aa, unidentified
MGEHIADQMTSLYSTSKTLRFRLEPIGETLNFIQKNAFLDKDKRKADDYVKIKVTIDEYHKAFIRDALSSVVREYEENQDLLNEGGKSDRKKISSEDFEELFTIYNNLKKDRSDEKNRTAFVHACKSLRQKIVKVAFPSDEIKELTSAKLFDKLPAWVVQENQKRSQDNKLFWTDTFKRFSSYFLGFHENRANMYSDEEKATAIAYRLVNENLPRFFDNIVIFNKIGHLFDDIKNSLTEKEEKLFYDYDFETVFSPEYYIHCLTQSDISRYNTLIGGYSTSDKEKVRGLNEFINLHNQKIKDKKNKIQPLKILYKQILSDRETVSFLPQQFSTTDEVYTKIVDFYLSCILDLCVDEKNGCNAFQILAQQFRKIQDNVFNREQIYISHRALSSISKKIFKNPFFIHDALDDYYRTVSVPDYDKKLLLSKTKTNRENLEKELDEFINKQFLPISLIDKACDNYLHKLDGKEETCVSSSVSEYCAHLLEWKKVINNEPKVFAPGKYEEAVYCSIKGELNSQHDVSYRPSSATVDKIKHFLDTLLASIRSIQDFIIPREKETLVEKDEDFYKVIDSVWEHLSSFSKLYDKARNFFSGKAYSTGKIRLTFGIPALADGWDENKESDCRALLFMKDEQYYLGIASKAGLKFDQFEKIPDGVPCYKKMVYKYFPGPTKMIPKCTVTTKDVKKHFKNETSDYILNDEKKYNSNLVISKYIYDLYSNSGSKPAFTDTYLKETNDTIGYKKALVEWIDFCKKFLKSYKSTADYNYDSLKESKDYTKINEFYNDVARLTYRIKFRQIPCDIIDNFVKSGKLYLFRIATKDFGCSHGHPNLHTLYWRALFSSANLNHTIIKLNGNANLFYRVSSIEEPTVHQKGSILVGRMTKDGKNIPEEIYLQVCQIANGKLDKKDVDGKVLKYFERSVQREAPYDIVKDRRYTKDVFLFHVPLTFNFGVEPVKNINEKVNDFLKEHDDVNIIGIDRGERNLLYISVVDTKGQILEQKSLNILDGIDYHDKLDLREKERAKARESWGSIGRIADLKEGYLSFVIHYLTDLIIRYNAIVVMEDLNVGFKRGRFKVEKQVYQKFEKALITKLNYLSFKDFPAEDEGGVLHGWQLTNPFESFRSMGHQNGIIFYIPAWNTSKIDPVTGFVDKIKPKYTNREAAHSLFSKFTKISYCHEDDVFDFLWKDESSNRTWTITTGGKERYYWSRDSSQYGSVQKADVTEILKETFKNAEIEWENGEDLIPILTASDNASLLRTVTWCLRLVLSMRYSSEADKCDFILSPVRMPSGCTFCSETAPDSLPMDADANGAYNIARKGAIVLDRIRVGVKNPTIIKNEDWLEYAQRDDIVALQESKYCE

SEQ ID NO: 223 - protein, 1126 aa, unidentified
MIQNNEYSADEKDEKLQLISLFSGFTTSLKNFFENRKNMFSAEDKQSSICHRIVNDNASIFFENVITYRKIKGSLSEDDFLRLENDIHEKLHGKSIDEIYAYDNYGRFITQDGINLYNEVCGRINLFMNLYCQQNNENKNVYKMRKLHKQILCIAESSYEVPYGFQSDEELYSSVNEFLNNLESKNIAERLRNIGQNYNKYELDKIYISSKNFETVSQKVYGDWNTIDSALEIYYTNTLPGSGKSKAEKVRKAVKNDLHKSITQINELVSEYKLCADEKVKVQDYIATINDITKYCDIRSLEYNPDINLTENEDKASELKKYLDMIMNIFHWCSVFMTDEILDKDVEFYSEIEDIYDEIAPIIKLYNRARNYITQKPYSTEKFELKFGSPTFADGFSKSKEYANNAILLQKDGLLYLGVFNVKNKPEKKMIEGHDLKENTDYKKIVYNLLPRPHNMLPKVFITSKTGIETFKPSSYILEGYKQKKHLKSSNTFDINYCHDLIDYYKECIAIHPEWKNFNFKFSDTSKYEDISGFYREVLIQGYKIDWTFISEGNINQLQENGQLYLFKVYNKDFSQNSKGKENLHTMYLKYLFSDENLNDVVLMLNSYANVFYRKSSIKSPITHKKGSMLINKTYVEEEKQEGKTVNVRKIVPDKVYMELYNHFNNNLGGTLSDEAQRIEKKVCHKATKDIIKDRRYTYDNFFINLPITINFKADESYAINHKMLQYISKQDDMHIIGIDRGERNLIYVSVIDTHGNIVEQKSFNIVGGYDYQDKLKKQENARQNARKEWKEVGKIKEIKEGYLSLVIHEIARMVIEYNAIIAMEDLSYGFKKGRFKVERQVYQKFETMLINKLNYLVFKDRKINENGGLLRGYQLTYIPQSLKNVGRQCGCIFYVPAAYTSKIDPTTGFADIFKFKNLTTEGKCEFIRSFEYIKYDSEREMFVFAFDYKNFATQNVEMAKNDWCVYTNGNRIKRKYVNGRFVNETDEIDINLLIKKSFEKTDISWQDGHDLRDEIIGYGIEAQIVDIFRMAVQMRNSRSEAEDRDYDRIISPVLNADGDFYESNKAVDVLPKDADANGAYCIALKGLYEVKQIQKNWKEGEKFPMDKLRITNKDWFDFVQNKRYL

SEQ ID NO: 224 - protein, 1245 aa, unidentified
MEISNRFTNKYQVSKTLRFRLEPTGGTDDLLCQAQIIDGDERRNKEAITMKQILDNCHKQIIERVLSDFNFKEHSLEEFFKVYTRNDDDREKDIENLQAKMRKKIADAFTKQDVTKLFSSKFKDFVERGLIKYASNEKERNIVSRFKGFATYFTGFNTNRLNMYSEEAKSTAISFRLINQNLIKFIDNILVYKKVSQTLPSDVLSNIYIDFKAIINTSSLEEFFSINNYNNILTQKQIEIFNAVIGGKKDKDEKIITKGFNQYINEYNQTNKNIRLPKMMRLFNQILSDREGVSARPEPFNNANETISSVRDCFTNEISKQITILSETTSKIESFDIDRIYIKGGEDLRALSNSIYGYFNYIHDRIADKWKHNNPQGKKSPESYQKNLNAYLKGIKSVSLHSIANICGDNKVIEYFRNLGAENTVDFQRENVVSLIDNKYNCASNLLSDAQITDEELRTNSRSIKDLLDAVKSAQRFFRLLCGSGNEPDKDHSFYDEYTPAFEALENSINPLYNKVRSFVTKKDFSTNKFKLNFDSSSFLSGWAKKSEYEKSSAFIFIRDNQYYLGINKCLSKEDIAYLEDSTSSSDTKRVVYMFQKVDATNIPRIFIRSKGPNLAPAVNEFQLPIETILDIYDNKFFTTSYQKTDRAKWKESLTKLIDYYKLGFSQHKSYADFDLKWKASSEYNDINDFLADVQRFCYRIEFININWDKLIEFTEDGKFYLFRIANKDLSGNSTGLPNLHTIYWKMLFDESNLKDIVYKLSGNAEVFMRYNSLKNPIVHKAGVEIKNKCPFTEKKTSIFDYDIIKDRRYTKDQLELHVPILMNFKSPSAAKGKAFNKECLEYIRNNGIKHIIGIDRGERNLLYMVITDLDGNIVEQKSLNQIASNPKLPLFRQDYNKLLKTKADANAQARRDWETIDTVKEIKFGFLSQIVHEIAMAIIKYDAIVVLENLNRGFMQKRGLENNVYQKFEQMLLDKLSYYVDKTKHPEEAGGALHAYQLSDTYANFNSLSKNAMVRQSGFVFYIPAWLTSKIDPVTGFASFLKFHRDDSMATIKSTISKFDCFKYDKECDMFHIRIDYNKFSTSCSGGQRKWDLFTFGDRILAERNTMQNSRYVYQTVNLTSEFKNLFATKDIDFSGNLKDSICKIEDVGFFRKLSQLLSLTLQLRNSNAETGEDFLISPVADKDGNFFDSRNCPDSLPKDADANGAYNIARKGLMLVEQLKRCKDVSKFKPVIKNEDWLDYVQR

SEQ ID NO: 225 - protein, 1271 aa, unidentified
MKEIKELTGLYSLTKTIGLELKPVGKTQQLIESKKLIEQDDQRAEDYKIVKDIIDRYHKDFIDKCLNSVEIKKEDLEEYVSLAENSNRNTKDFDEVKTKMRNQITEAFKKNHLFTGLFKKNLIKDYLPDFVSEEEKNVVNKFSKFTTYFDAFNNNRKNLYSGDAKSGTIAYRLIHENLPMFLDNIASFNKISETRVNEYFSSIEAEFTDTLNGKHLADLFQIDYFNNTLTQKKIDNYNYIVGAVNKAVNLYKQQHKNIRIPLLKKIHKMILSDRVTPSWLPERFESDEEMLTAIKATYESLKEVLVGDDDDSLRNLLLNIDNFDLEHIYIAKDSGLTSISQQIFGYYDTYTLAIKDQLQRKNPATKKQRENPNLYDERIDKLYKKEGSFSIAYLNRLVDTKEHITINEYYRLLGSYCREGGKSNDDFFKQIDGAYSAISYLFSAEHGEIAQSDSDTAVVQKLLEAYKGLQRFIKPLLGHGDEADKDNEFDVKLRKVWDELNIITPLYDKVRNWLSRKIYNPEKIKLYFENNGKLLSGWSDSQTEYDNGTQYGGYIFRKKNEIGEYDFYLGISADAKLFRRDETICYEDGMYERLDYYNLKPNTLLGNSYIGNYGEDSNAVLSAFNDAVTKLHLEKKLVPKDNEKVPTYLKRLKQDYANFYQILMNDNNVVDAYKSMKQHILATLASLIRVPAAIELTTQTNLDIDKLIDEIINLPSESFGYFPVATAAIEEANNREKKPLFLFKMSNKDLSYAEKFSKGDRKSRGTENLHTMYLKALLGMTQNVFSIGSGMVFFRHNTEGLAETTARHKANEFIANKNKLNDKKKSIFDYEIVKNKRFTVDKYLFHLSLKLNYTQPNKFDINSKVREIIRNGGIKHIIGIDRGERNLIYLSLIDMEGNIVMQKSLNILKDDHNAKGTDYKGLLTEREGENKEARRNWKKIANIKDLKRGYLSQVVHIISKMMVEYNAIVVLEDLNPGFIRGRQKIERNVYEQFERMLIDKLNFYVDKHKDANETGGLLHALQLTSEFKNFKKSEHQNGCLFYIPAWNTSKIDPATGFVNLFDTRYTNAEKALEFFRKFDAIRYNEEKDWFEFEFDYDEFTQKAHGTRTRWTLCTHGKRLRSFRNPAKQYNWDSEVVALTDEFKRILGEAGIDIHENLKDAIRNLEGKRRKYLEPLMQFMKLLLQLRNSRKNPEEDYILSPVADENGVFYDSRSCGDTLPKNADANGAYNIARKGLMLIRQIKEAKELGKVKYDISNKAWLNFAQQKPYKNE

SEQ ID NO: 226 - protein, 1279 aa, unidentified
MNILKENYMKEIKELTGLYSLTKTIGVELKPVGKTQELVEAKKLIEQDDQRAEDYKIVKDIIDRYHKDFIDKCLNCVKIKKDDLEKYVSLAENSNRDAEDFDNIKTQMRNQITEAFRKNSLFTNLFKKNLIKEYLPAFVSEEEKSVVNKFSKFTTYFDAFNDNRKNLYSGDAKSGTIAYRLIHENLPMFLDNIASFNKISETGVNEYFSSIEAEFTDTLNGKYLADLFQIDYFNNTLTQKKIDNYNYIVGAVNKAVNLYKQQYKNVRVPLLKKIHKMILSDRVTPSWLPERFESDEEMLTAIKETYESLKDVLVGYNDDSLRNLLLNIDNYDLDHIYIANDSGLTSISQKIFGCYDTYTLAIKYQLQRKHPATKKQKEAPDLYEERIDKLYKKEVSFSIAYLNRLVDTNEHITINEYYRQLGSYCREEGKSKDDFFKQIYGAYSDMLYLFSAEHGEIAQSDSDTAVVQKLLEAYKGLQRFIKPLLGHGDEADKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAINYDDGMYERLDYYQLKSKTLLGKSYAGDYGLDSMNLLSALKNAAAKFQFEKEMIPKDKENVPKYLKRLKLDYAGFYQILMNDDKVVDAYKSMKQHILATLASSIRVPVAKELATQTELGIDELIDEIMNLPSKSFGYFPIATAAIEEANKRENKPLFLFKMSNKDLSYAATASKGLRKGRGTENLHTMYLKALLGMTQSVFDIGSGMVFFRHQTKGLAETTARHKANEFIANKNKLNDKKKSIFGYEIVKNKRFTVDKYLFKLSMNLNYSQPNKFDVNSKVREIISNGGIKHIIGIDRGERNLLYLSLIDLKGNIVMQKSLNILKDEHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKDANETGGLLHALQLTSEFENFKKSEHQNGCLFYIPAWNTSKIDPATGFVNLFDTRYTNANKALEFFSKFDEIRYNEEKDWFEFEFDYDEFTQKAHGTRTKWTLCTYGMRLRSFKNPAKQYNWDSEVVALTDEFKRILEEAGIDIHENLKDAIRNLKGKKQKYLEPLMQFMKLLLQLRNSKAGTDEDYILSPVVDENGIFYDSRSCGDELPENADANGAYNIARKGLMMIEQIKDAKDLDNLKFDISNKAWLNFAQQKPYKNG

SEQ ID NO: 227 - protein, 1279 aa, unidentified
MNILKVNYMKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNQITEAFRKNSLFTNLFKKNLIKEYLPAFVSEEEKSVVNKFSKFTTYFDAFNDNRKNLYSGDAKSGTIAYRLIHENLPMFLDNIASFNAISGTGVNECFSGIETDFTDTLEGKRLTEFFQIDFFNNTLTQKKIDNYNYIVGAVNKAVNLYKQQHKTVRVPLLKPLYKMILSDRIAPSWLPECFKSDNDMLTAIKAAYESLRNVLVGDNDDSLRNLLLNIDHYDLEHIYIANDSGLTSISQKIFGCYDTYTLAIKDQLQRDYPATKKQREAPDLYDERIGKLYKKVGSFSIAYLNRLVDAKGHFAINEYYKQLGSYCREEVKEKDDFFKQIDGAYSAISHLFFGEHGEIAQSDSDVELVQKLLDAYKGVQRFIKPLLGHGDEVDKDNEFDAKLRKVWDELDIITPLYDKVRNWLSRKIYNPEKIKLCFENNGKLLSGWVDSRTKSDNGTQYGGYIFRKKNEIGEYDFYLGISADTKLFRRDAAISYDDGMYERLDYYQLKSKTLLGNSYAGDYGLDSMNLLSAFKNAAAKFQFEKEVVPKDKENVSKYLKRLKLDYAGFYQILMNDDKVVDAYKSMKQHILATLASSIRVPAAIELATQTELGIDELIDEIMNLPSKSFGYFPIVTAAIEEANKRENKPLFLFKMSNKDLSYAATAFKGLRKGRGTENLHTMYLKALLGMTQSVFDIGSGMVFFRHQTKGLAETTARHKANEFVANKNKLNDKKKSIFGYEIVKNKRFTVDKYLFKLSMNLNYSQPNKFDVNSKVREIISNGGIKHIIGIDRGERNLLYLSLIDLKGNIVMQKSLNILKNDHNVKGTDYKGLLTEREGERKDARHNWKKIANIKDLKRGYLSQVVHIISKMIVEYNAIVVLEDLNPGFIRGRQKIERNVYDQFEKMLIDKLNFYVDKHKDFNEVGGLLHALQLTSEFKNFKKSEHQNGCLFYIPAWNTSKIDPATGFVNLFNTKYTNVVEAHEFFSKFDAIRYNDEKDWFEFEFDYDNFTQKAHGTRTRWTLCTHGKRLRSFKNSAKQYNWDSEVVALTDEFKRILGEAGIDIHENLKDAICNLEGKSQKYLEPLMQFMKLLLQLRNSKAGTDEDYILSPVADENGIFYDSRSCGDELPENADANGAYNIARKGLMMIEQIKDAKDLDNLKFDISNKSWLNFAQQKPYKNE

SEQ ID NO: 228 - protein, 1271 aa, unidentified
MKEIKELTGLYSLTKTIGIELKPVGKTQELIEARKLIEQDDQRAEDYKIVKDIIDRYHKDFIDKCLNCVKIEKDDLEKYVSLTENSNREAVDFDNIKTKMRNQITESFKKNPLFVGLFKKELITNYLPNFVSEEERVVVNKFSKFTTYFDAFNNNRKNLYSGDAKSGTIAYRLIHENLPMFLDNIASFNKISETGVNEYFSSIEAEFTDTLNGKHLADLFQIDYFNNTLTQKKIDNYNYIVGAVNKAVNLYKQQHKNVRIPLLKKIHKMILSDRVTPSWLPERFESDEEMLTAIKAAYESLKEVLVGDDDDSLRNLLLNIDNFDLEHIYIAKDSGLTSISQQIFGYYDTYTLAIKDQLQRKNPATKKQRENPNLYDERIDKLYKKEGSFSIAYLNRLVDTKEHITINEYYRLLGSYCREGGKSNNDFFKQIDGAYSAISYLFSAEHGEIAQSDSDTAVVQKLLEVYKGLQRFIKPLLGHGDEADKDNEFDAKLHKVWDELDIITPLYDKVRNWLSRKIYNPEKIKLCFENNGKLLSGWSDNQTKSDNGTQYGGYIFRKKNEIGEYDFYLGVSSDAKLFRHDATIGYEDGMYERFDYYQLKSKTLLGKSYVGNYGEDSNAVLSAFNNAVTKLHLEKKLVPKDNENVPKYLKRLKQDYAGFYQILMNDDNVVDAYNSMKQHILATLASLSRVPAAIELATQTDLDIDDLIDEIMKLPSESFGYFPVATAAIEEAKKREKKPLFLFKMSNKDLSYAEKSSKGLRKSRGTENLHTMYLKALLGMTQNVFSIGSGMVFFRHQTKGLAETTARHKANEFIANKNKLNDKKKSIFDYEIVKNKRFIKDKYLFHLSMNLNYSQPNKFDINSKVREIIRNGGIKHIIGIDRGERNLIYLSLIDMEGNIVMQKSLNILKDDHNAKGTDYKGLLTEREGENKEARRNWKMIANIKDLKRGYLSQVVHIISKMMVEYDAIVVLEDLNPGFIRGRQKIERNVYEQFERMLIDKLNFYVDKHKDANETGGLLHALQLTSEFKNFKKSDHQNGCLFYIPAWNTSKIDPATGFVNLFDTRYTNADKALEFFSKFDAIRYNEEKDWFEFEFDYDEFTQKAHGTRTRWTLCTYGKRLRSFKNPTKQYNWDSEVVALTDEFKRMFREADIDIHENLKDAIRNLEGKRRKYLEPLMQFMRLLLQLRNSKAGTDEDYILSPVADENGVFYDSRSCGDQLPENADANGAYNIARKGLMLIRQIKETKDLANFKYDISNKAWLNFAQQKPYKNE

SEQ ID NO: 229 - protein, 1270 aa, unidentified
MNILKENYMKEIKELTGLYSLTKTIGVELKPVGKTQELVEAKKLIEQDDQRAEDYKIVKDIIDRYHKDFIDKCLNCVKIKKDDLEKYVSLAENSNRDAEDFDNIKTKMRNQITEAFRKNSLFTNLFKKNLIKEYLPAFVSEEEKSVVNKFSKFTTYFDAFNDNRKNLYSGDAKSGTIAYRLIHENLPIFLDNIASFNIISETGVNEYFSGIETEFTDTLEGKRLTELFQIDFFNNTLTQKKIDNYNYIVGAVNKAVNLYKQQHKTVRVPLLKTLHKMILSERVTPSWLPERFESDEEMLTAIKETYESLKDVLVGDNDDSLRNLLLNIDNFDLEHIYIANDSGLTSISQQIFGYYDTYTLAIKDQLQRENPNLYDERIDKLYKKEGSFSIAYLNRLVDTKEHITINEYYRLLGSYCREEGKRKDDFFKQIYSAYGDMLYLFSAEHGEIAQSDSDTAVVQKLLEAYKGLQRFIKPLLGHGEEADKDNEFDAKLRKVWDELDIITPLYDKVRNWLSRKIYNPEKIKLYFENNGKLLSGWSDNQTKSDNGTQYGGYIFRKKNEIGEYDFYLGISTDAKLFRRDETICYEDGMYERFDYYHLKPTTLLGKSYIGNYGEDSNAVLSAFNAAITKLHLEKKLVPKDNEKVPTYLKRLKQKYANFYQILMNDVNVVDAYKSMKQHILATLASLIRVPAAIELAAQTDLDIDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDNNAKGTDYKGLLTEREGKRQDARRNWKKIANIKDLKRGYLSQVVHIISKMLVEYNAIVVLEDLNPGFIRGRQKIERNVYEQFERMLIDKLNFYVDKHKDANETGGLLHALQLTSEFENFKKSEHQNGCLFYIPAWNTSKIDPATGFANLLDTRYTNADKAREFFKKFDAIRYNEDKDWFEFEFDYDNFNQKAHGTRTKWTLCTYGNRLRSSRNPAKQYNRYPELVVLTDEFKRILGEVGIDIHENLKEAICKLEDKKHLEPLMQFMKLLLQLRNSRTNPEEDYILSPVADENGRFYDSRSCGDDLPENADANGAYNIARKGLMMIEQIKDAKDLDNLKFDISNKSWLNFAQQKPYKNG

SEQ ID NO: 230 - protein, 1302 aa, unidentified
MPNISEFSEHFQKTLTLRNELVPVGKTLENIISSNVLINDEKRSEDYKKAKEIIDSYHQEFIEKSLSSVTVDWNDLFSFLSRKEPEDYEEKQKFLEELESIQLEKRKSIVNQFEQYDFGSYTDLKGKKTKELSFESLFKSELFDFLLPNFIKNNEDKKIISSFNKFTSYFTGFYENRKNLYTSAPLPTAVAYRIVNDNFPKFISNQKIFRVWKDNVPKFVEIAKTKLREKGISDLNLEFQFELSNFNSCLNQTGIDSYNELIGQLNFAINLECQQDKNLSELLRKKRSLKMIPLYKQILSDKDSSFCIDEFENDESAINDVISFYKKAVCENGPQRKLSELLRDLSSHDLDKIFIQGKNLNSISKNLFGGKNWSLLRDAIIAEKSKDKSYKKAIKTNPSSDDLDRILSKDEFSISYLSKVCGKDLCEEIDKFIKNQDELLIKINSQAWPSSLKNSDEKNLIKSPLDFLLNFYRFAQAFSSNNTDKDMSLYADYDVSLSLLVSVIGLYNKVRNYATKKPYSLEKIKLNFENPNLATGWSENKENDCLSVILLKNQIYYLGILNKSNKPNFSNGISQQPSSESCYKKMRYLLFKGFNKMLPKCAFTGEVKEHFKESSEDYHLYNKDTFVYPLVINKEIFDLACSTEKVKKFQKAYEKVNYAEYRQSLIKWISFGLEFLSAYKTTSQFDLSNLRKPEEYSDLKEFYEDVDNLTYKIELVDLKEEYVDSLVENGQLFLFEIRNKDFAKKSSGTPNLHTLYFKSIFDPRNLKNCIVKLNGEAEIFYRKKSLKIDDITVHQKGSCLVNKVFFNPDSGKSEQIPDKIYNNIYAYVNGKSTTLSKEDEFFYTKATIKKATHEIVKDKRFTVDKFFFHCPITINYKSKDKPTKFNDRVLDFLRKNEDINIIGIDRGERNLIYATVINQKGEIIDCRSFNTIKHQSSSVNYDVDYHNKLQERENNRKEEKRSWNSISKIADLKEGYLSAVIHEIALMMVKYNAIVVMENLNQGFKRIRGGIAERSVYQKFEKMLIDKLNYFVIKNENWTNPGGVLNGYQLTNKVPTIKEIGNQCGFLFYVPAAYTSKIDPSTGFVNLLNFNKYNNSDKRRELICKFYEICYVQNENLFKFSIDYGKLCPDSKIPVKKWDIFSYGKRIVKEDLKTGYMKENPEYDPTEELKNLFTLMMVEYKKGENILETISIRDMSREFWNSLFKIFKAILQMRNSLTNSPVDRLLSPVKGKDATFFDTDKVDGTKFEKLKDADANGAYNIALKGLLILKNNDSVKTDKELKNVKKVSLEDWLKFVQISLRG

SEQ ID NO: 231 - protein, 1268 aa, unidentified
MTYNNFTGIAQCSKTIRNEIIPVGWTKQLIKNNEILESDEKRDEKSEELKKLMDDYYRTYIDGKLSPVRDLDWSELFEVLDVALKRGAKKEDRTTLQKVRKNMLEKVYAKLDVKANKEMLGGKMVTKILPDFIKNNAEYTDEEKEQYFDTIKLFKGFTTSLKKFLKTRENVFSEKDIPTSICYRIVWENADIFYKNIKAFEKIKESATQEIEKLEEECRQQSAEHSASQMFSAEFYNCVLTQTGIEFYNDVCGRINKHMNLYYQQTKEKTGRYLMKKLHKQILSISSTRYEVPHMYENDDEVYDSINSFVKRLKDDSKLKSMIGNLLKKSQLYDYDEIFVDAKRYESVSTTISGSWDTVVRCITRYYDDNTVTKKDRQKKIENKVKNEKYRSLTGIYKVVMSYESREKFKSTNEYEYLHELEKIYNDDKLQLIEHYGSKKLIEDDVKIAEIKEMLDMLLKVRHFLDTFIEPEYENIDVDFYNEREEILEILDGIVALYNRVRNYVTQKPYSKDKYKLNFNCSSLGTGWSRNTEHSYKTIILRKNGLYYLGIYNAMNMPDEEIMEGNLGDVGDSYEKMVYGALPTRKLLNWCVTSDEAVKKYNPPQNIIDGCNNGRQGGNNFDINFCHELIDYLKACIKTNPKWSELKFNFSDTNKYGSLKDFYDEISEQGYKVSWVNIPKEDIERLNREGQIYLFQIYNKDFSDKSTGTPNLHTMYFKNIFSEENMREEVIMLNGGAELFFRKASIENKIEHKEGTVLVNKTYKEMMGGEEVRVPVPEKEYVEIYTYLNNGKSTKLSDSAQKLFDSGKIEYREAKKNITKDRRYTEDKFFLHIPITINYKVTKNNIRLNEQVLDYISEQKNLHIIGIDRGERNLIYVSVIDMNGRIVKQKSYNIVSGYDYQKKLVEREIARDDARKSWKEVGKITDLKEGYLSQVVHEISQMVLEYNAVIAMEELNYGFKRGRFKVERQVYQKFETMLISKLNYLVDKKKKVDEPGGVLKGYQLTYVPEKVTDVGKQCGIIFYVPPAYTSKIDPTTGFVDLFDFKADKPRKFLSRFDSIRYVKAGEEQDMFAFSFDYDNFAIHNTTPVIKKWIAYTYGSRIKKKPDIKNGKRVYSYEKLELTDEMKKLLNQNEISYCDGHNIVDDIKALDDKEKEALTDGIFNLFRLTVQLRNSMSEAEDYDMIVSPIRNDSGEFFDSSKYKNDNFGKESVDMPKDADANGAYCIAMKCLFEMKKVQQGWSESDKKNFDFLTVTNEDWFDFMQNKRYL

SEQ ID NO: 232 - protein, 1272 aa, unidentified
MNILKENYMKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNQITEAFRKNSLFTNLFKKNLIKEYLPAFVSEEEKSVVNKFSKFTTYFDAFNDNRKNLYSGDAKSGTIAYRLIHENLPVFLDNIASFNAISGTGVNECFLGIETEFTDTLKGKRLTEFFQIDFFNNTLTQKKIDNYNYIVGAVNKAVNLYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLSGWSDNQTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 233 - protein, 1302 aa, unidentified
MSKLSTFNEHFQKTLTLRNELVPVGKTLENIISSNVLINDEKRSEDYKKAKEIIDSYHRDFIEKSLSSVNVDWNDLYLYLSKKEPEDYDQKQKFLEELENILLEKRKIIVKQFEQYDFGSYTDSKSKKTKDLKFENLFKAELFDYLLPNFIKNDEDKKVIGSFNKFTSYFTGFYENRKNLYKSDPLPTAVAYRIVNENFPKFISNKNIFRVWNDNVPQFVEIAKTKLIEAHIAALNIESKFELSNFNSCLNQTGIDTYNDLIGQLNFAINLECQKDKNLCELLRKKRSLKMAPLYKQILSDKDSSFSIDEFDNDESAIKAVISFYKKMVGENCPQRTLSELLHEMSSHDLEKIFVQGKNLNSVSKNLFGGKNWSFLRDAVIEEKSKEKGFKRVIKSNSTAEELDKVLSKAEFSISFLSKVSGKDLSVEIDKFVKNQDEQLDEIKSQTWPISLKKSEEKNLIKAPLDFLLNFYRFAQSFSSNNIDKDMSFYADFDLSLRSISDVIGLYNKVRNYATKKTYTLEKIKLNFENPNLASGWSESKENDCLSIILLKEKKYFLGIFNKNNKPDFSECISQPHSSNGCYRKMRYLLFKGFNKMLPKCAFTGEVKEHFKESSDDFSLFNKDTFVSPLVITKEIFDLACSKEKVKKFQKEYEKINRTEYRQSLIKWIAFGLKFLSSYKTTSQFDLSNLKRPEEYSDLKEFYEDVDNLTYKIEFLNIKEEYVDTLVENGQLYLFEIRNKDFAKNASGTPNLHTLYFKSIFDLKNLENGIVKLNGEAEIFYRKKSLKKDDITVHREGSYLVNKVCVDPNSGKSEQIPDKIYENIYAFVNGKSRDLSKEDEVYYAKSTIKKATHEIVKDRRFTVDKFFFHCPITINYKSKDKPSKFNDKVLDFLRNNKDINIMGIDRGERNLIYATVINQNGEIVDCKTFNTIKHQSSSVNYDVDYHNKLQEREKSRKEEKRSWNSITKIADLKEGYLSAVIHEISLMMVKYNAIVVMENLNQGFKRIRCGIAERAVYQKFEKMLIDKLNYFVIKNETWTNPGGVLNGYQLTNKVSTIKDIGNQCGFLFYVPAAYTSKIDPSTGFVNLLNFNKYKNSEERRKLICSFDKVCFVQNEDLFKFSIDYGKLCPDSKVPVKKWDIFSYGTRIVKENLTSGHLKENPEFDPTEELKTLLSSSGIEYQKGQNLLETISTRVMPREFWNSLFKIFKAILQMRNSLTNSPVDRLLSPVKGKDGTFFDTDKVEGTKFEKLKDADANGAYNIALKGLLVLDKNDSVKSDKDLKNVKKISLEDWLKFVQISLRS

SEQ ID NO: 234 - protein, 1279 aa, unidentified
MKNLTNLYSLQKTLRFELKPIPVARETPEQAHERLTRAPFFNADAERERSYEDVKTLIDDCLRDFIEEKLAGARLDWKPLADAIDAKDKKTLAAAESAARKAVVALFGSTKDLLGGKIFASALPRRLEKYPESEQADKRAAYEKFKKFTTYFTGFWENRKNVFSDKEQHTALAFRVVNENFPKFKANVLAFENAPEAVRAQLAENFPDVDLAEAFSVPAFNDALTQRGIDAHNALVGGKPAENGAEKIQGFNELVNLWRQQHPGEKPQKMQLLYKQILSDKKNEFAARLLQSDQDVVRLLKRLRERFFGVSDGETLSAAEKIAALLSALETYDENRIWIARKTATEISLALFGRWDALNAALKISDEDGNDGKKKEQIFSLGEIRAAVEDARASAEDENDGSERIASLSDFFKSVKTADAENRGNARPFLPFEEFAAEARAKFDAAIAEAEKAEKLLGNERRIGKIKAALDDALAIFRKARALKPSEKSLSGKSRDEAFYAELEDALFPIADCASAYDKIRNYLTKKPFSDDKMKLSFDCPTLANGWDENKIEANHALILRRGGKYFLGILNKSLTSEKCREILTIEAESGVPADACFERLVYKYLADPVKMLPKVFFSEKGVAAHNPPPELVAKETRNLDTAKLIRFYQAEIPKYNRGDWNVFRFKFKKPEEYQTPKEFYDDVARQNYRIDFKRVPAEKIDAFVADGALFLFEIYSKDFAAGATGKKNLHTIFWEAAFSPENAAAGFSVKLNGEAEIFWRKASLGENETPVHAPGSVLVNRRDADGNVIPEDVYQEIFKLKNGKLAAGALSDEARRLLASGKVKFKNAKIEIRKDRRYTVDKFLFHVPLTFNRVPREKNFTAKMLDEKVRELACAENSPMKIIGIDRGERNLISLVMINRHGEIEKQMSFNVIEEFSGGRSRATNYQAMLVAREAQRDAARKSWKSIGKIAELKEGYISQVVHEIAKLVVENDALVVLENLNVGFKRGRFKVERQVYQKFEKALIEKLNFLVLKDRAPSETGGVLNALQLTKKFESFEKLGQQSGILFYVPAGYTSKIDPLTGFANIFDLSGITNARAKRDFFSKFSSVRFDAGTQSFAFDFDYKNFRTFKQKFARTRWTVYSRGDRIVWNSKNRKSEHISPTEKMREALAGLNVAFAPGEDIRKKISDADVEKQESKRHWDTLFRAFKCALQMRNSVAKSTEPQDDWIASPVKAADGSFFDSRAQQQNEALPHDADANGAYHIALKGLMGVRKNFASGWQKNETWFEFVQKTLRERS

SEQ ID NO: 235 - protein, 1303 aa, unidentified
MSKLSTFNEHFQKTITLRNELVPVGKTLENIISSNVLINDEKRSEDYKKAKEIIDSYHQEFIEKSLSKVDIEWDDLAYCLTKKEPENFDKKKKYQEEINKLQNEKRKKIVEIFKKFSFGVLCDNNGQEVKIKFDDLFKSTLFKYVLPNFLKNDEDKTVVRDFSEFTSYFTGFHENRKNLYKSAPMPTAVAYRIVNDNFPKFISNQKIFCAWKDNVPHFVEIAKTKLSEVGISDLDIESKFELSNFNSCLNQTGIDYYNDLRGQLNNVISHICQQDKNLGDLLRKKRCLKMVPLYKQILSDKDSSFSIDEFDNDESAIQDVISFYKKMVGERCPQRKLSELLRELSSHDREKIFIQGKNLNSISRILFGGKNWSLLREAIIEEKSKDKSFKKAIKSNSTDEALEKILSKDEFSISFLSRICHENLSEKIDKFIKNQDEQLININSQTWPKTLKNSEEKKIIKEHLDFLLNFYRFAKSFSSNTIDKDMSFYADFDESLSSLENVIGLYNKVRNYVTKKPYSLEKIKLNFEIPNLAEGWSKTKELANLTVIFLKDNEYYLGIINKNSKIDFSLIKEKTSSENCFRKMEYSLFGKIAQNINRCVFTKAVKNHFSKSPDNFILSDKKKFLKEIEITKEIYDLVKSDESDKKYLKEYKKINEKEFRSALSKWINFCIEFLKSYKNTSQFDFSCIKKAESYDDINDFYDDIEKVTYKIEFVDISTSLIDALVDKGQLFLFKIRNKDFAKKASGTPNLHTLYFKSIFDTKNFENGIVKLNGEAEIFYRKKSLNVDDTTVHQKGSYIVNKVVVDPSSGKSEQIPDNVYNNIYAFVNGKLKTLSKEGDEVYYAKATIKKATHEIVKDRRFTEDKFFFHCPITINYKSKEKPSKFNDKVLDFLRKNDDINIIGIDRGERNLIYATVINKNGEIIDCKSFNTIKHQSSSVNFDVDYHNKLQEREKNRKEEKRSWNSISKIADLKEGYLSAVIHEIALMMVKYNAIVVMENLNQGFKKIRGGIAERSVYQKFEKMLIDKLNYFVIKNENWTNPGGVLNGYQLTNKVSTIKDIGNQCGFLFYVPAAYTSKIDPSTGFVNLINFNKYKNSNDRRKLICSFYKICFVQNENLFKFSIDYEKLCPNSKMPVKKWDIFSYGNRIVREDLKHIPMKENPKYDPTEELKTLFSSKEIEYQKGQNLLEIISTKDMTEDKEFWNSLFNIFKAILQMRNSLTNSPVDRLLSPVKGKDGSFFDTDKVEGTKFEKLKDADANGAYNIALKGLLVLKKNDSVKTDKDMKNVKNVSLEDWLKFVQVTLRV

SEQ ID NO: 236 - protein, 1348 aa, unidentified
MNILKENYMKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNQITESFKKNPLFVGLFKKELITNYLPNFVSEEERVVVNKFSKFTTYFDAFNDNRKNLYSGDAKSGTIAYRLIHENLPMFLDNIASFNKISETGVNKYFSDIENEFTAILYEMHLSDLFQIDYFNNTLTQKKIDNYNYIVGAVNKAVNLYKQQHKTVRVPLLKTLHKMILSERVTPSWLPERFESDEEMLTAIKETYESLKDVLVGGNDDSLRNLLLNIDNFDLEHIYIANDSGLTSISQQIFGYYDTYTLAIKDQLQRENPATKKQRENPATKKQRENPNLNDDCIDKLYKKEGSFSIAYLNRLVDTKEHITINEYYRLLGSYCREEGKRKDDFFKQIDGAYSDMLYLFSTEHGEIAQSDSDTAVVQQLLEAYKGLQRFIKPLLGHGDEADKDNEFDAKLRKVWDELNIITPLYDKVRNWLSRKIYNPEKIKLYFENNGKLLSGWSDSQTEKDNGTQYGGYIFRKKNEIGEYDFYLGISTDAKLFRRDETICYEDGMYERFDYYHLKPTTLLGKSYIGNYGEDSNAVLSAFKNAVTKLHLEKKLVPKDNEKVPTYLKRFKQYYADFYQILMNDDIVVNANKRENSQDSEEVLSAFKNAVTKLHLEKKLVPKDNEKVPTYLKRLKQKYANFYQILMNDVNVVDAYKSMKQHILATLASLIRVPAAIELAAQTDLDIDELIDEIMNLPSESFGYFPVATAAIEEANKREKKPLLLFKMSNKDLSYAAKSSEGLRKSRGTENLHTMYLKALLGMTQNVFSIGSGMVFFRHKTKGLAETTARHKANEFVANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMLVEYNAIVVLEDLNPGFIRGRQKIERNVYEQFERMLIDKLNFYVDKHKDINEVGGLLHAFQLTSEFKKFKKSEYQNGCLFYIPAWKTSKIDPATGFANLLDTRYTNADKALEFFRKFDAIRYNEEKDWFEFEFDYDKFTQKAHGTRTKWILCTHGKRLRFKRNSTRVQEVVVLTDEFKKILGEAGIDIHVNLKEAICNLEGKKNLEPLMQFMKLLLQLRNSKAGTDEDYILSPVADENGIFYDSRSCGEQLPENADANGAYNIARKGLMLIRQIKEAKELDKVKFDISNKAWLNFAQQKPYKNG

SEQ ID NO: 237 - protein, 1274 aa, unidentified
MKEIKDLTGLYSLTKTIGLELKPVSKKTKKLIKSKKLIKQDDQRAEDYKIVKGIIDRYHKDFIDKCLNSVKIKKDDLEKYVSLAENSKKNENKLNEVKKEMRKQITDAFEKNSLFTDLFNQNLIKKYLPDSDSVSEEEKKVLNKFSKITTYFDAFNENRKNLYSVDAKSGTIAYRLIHENLPTFLDNIASFNKISEIGVYEYFSSIETEFTAILNGMHLSDLFQIDYFNNTLTQKKIENYNHVVGAVNKAANLYKQQHKNVRISLLKTLKKMILSDKVTPSWLPERFESDEEMLTAIKETYESLKDVLVGDNDDNLRNLLFNIDNYDLDHIYIANDSGLTSISQKIFGYYDTYTLAIKYQLQRKYPATKKQKEAPDLYEERIDKLYKKEGSFSIAYLNRLVDTKEHITINEYYRLLGSYCREEGKRKDDFFKQIDGAYSDMLYLFSAEHGEIAQSDSDTAVVQQLLEAYKGLQRFIKPLLGHGDEVDKDNEFDVKIRKVWDELDIITPLYDKVRNWLSRKIYNPEKIKLYFENNGKLLSGWSDNQTKSDNGTQYGGYIFRKKNEIGEYDFYLGISADAKLFRRDETICYEDDMYERFDYYHLKPTTLLGKSYIGNYGEESNAVLSAFNAAITKLQLKKELAPKDNEKVSTYLKRLKQDYANFYQILMNDDNVVDAYKSMKQHILATLASLIRVPAAIELATQTDLDIDELIDEIMNLPSESFGYFPVATAAIEEANKREKKPLFLFKMSNKDLSYAAKSSKGKRKSRGTDNLHTMYLKALLGMTQNVFSIGSGMVFFRHKTKGLAETTARHKANEFIANKNKLNDKKKSVFDYEIIKNKRFISDKYLFHLSLKLNYTQPNKFDVNSKVREIIRNGGIEHIIGIDRGERNLLYLSLIDMKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFEKTLIDKLNFYVDKHKDVNEAGGLLHALQLTSEFKNFKKSEHQNGCLFYIPAWNTSKIDPATGFVNLFDTRYTNAEKALEFFSKFDAIRYNEEKDWFEFEFGYDEFTQKAHGTRTRWTLCTHGKRLRSFRNPAKQYNWDSEVVTLTDEFKRILGEAGIDIHENLKDAIRNLEGKRRKYLEPLMQFMKLLLQLRNSRKNPEEDYILSPVADENGVFYDSRSCGDQLPENADANGAYNIARKGLMLIRQIKEAKELGKIKFDISNKAWLNFAQQKPYKND

SEQ ID NO: 238 - protein, 1294 aa, unidentified
MVTFEDFTKQYQVSKTLRFELIPQGKTLENIEKMRIISEDKQRDEDYQKAKKILDKIYKYILDIALKQVNIDWRELEKATIEFRRTKDRKKYEMVQREKRKELFSYIEKQEIKVKKKTVKLEKAMFGKEIITGDIINNFPEIELTEEEKFILDKFRKFTTYFKKFQENRKNIFTSEGISTSFTYRAVNDNFVKFFDNCKILENIVQASPDIAKSLETCASDLGIFPGVSLEEVFSISFYNRLLTQTGIDQFNQLLGGISGKVGEYKQQGLNEIINLAIQQDINVKESLKNKAHRFTPLFKQILSDRSTLSFISVAFVDDKDVLTAIDEYRKYLLEKNIGDRVFQLISDMEAYSPELMSIGGKYVSVLSHLLFNSWSEIRDGVKAYKESLITGKKTKKELENIDKGIKYGVTLQEIKEALPKQNFYEEVKKYATSVVRDYRAGLAEALPEKIETDDERASIKYIMDSMLGLYRLLEYFSHDSIEDTDPVFGVLLNGILTDMNETISLYNKVRNFSTRKIYSTEKFKLNFNSSLLASGWDKNKEQANGAILLRKEGEYFLGIFNFENKPQLVSDGGVGTGYEKMIYKQVSGFAKTLYKCAISLKDTKAHFQKFDEDFTLKTDEFEKSLVITKQIYDLGTQTVNGKKKFQVEYSRLTGDMEGYKAALKEWIDFGKEFIQAYASTAIYDISLFRDSSDYSDIQSFYKDADNICYKLSFEWISDEVINNCIDDGSLYLFKLHNKDFSAGSIGKPNLHTLYWKALFEEDNLSNGILKLDVQAELFYRPKSLTRPVVHEAGEVIINKTTSTGLPVPDDVYVELSKFVRNGKKGNLTDKAKNWLDKVTVRKTPHAITKDRRFTVDKFFFHVPITLNYKADSSPYRFNDFVHQYVKDCSDVNIIGIDRGERNLIYAVVIDGKGNIIEQRSFNTVGTYNYQEKLEQKEKERQTARQDWATVTKIKDLKQGYLSAVVHELSKMIVKYKALVVLENLNVGFKRMRSGIAERSVYQQFEKALIDKLNYLVFKDEEQSGYGGVLNAYQLTDKFESFSKMGQQTGFLFYVPAAYTSKIDPLTGFINPFSWKHVKNREDRRNFLNLFSKLYYDVNTHDFVLAYHHSNKDSKYTIKGNWEIADWDILIQENKEVFGKTGTPYCVGKRIVYMDDSTTGHNRMCAYYPHTELKKLLSEYGIEYTSGQDLLKIIQELDDDKLVKGLFYIIKAALQMRNSNSETGEDYISSPIEGRPGICFDSRAEDDTLPYDADANGAFHIAMKGLLLTERIRNDDKLAISNEEWLNYIQEMRG

SEQ ID NO: 239 - protein, 1289 aa, unidentified
MNDKNTPSFNKLTNLYSVSKTLRFELRPQFSTLEHIKDNKIIQKGEELKSHYEIFKKILDQVFIKLIDDSLDHTYFDLKLIEQFKDLKFKRREQFTEKDAANLRNLKEIMKKQIDKNLDSPEKKSIFKDPANFLLDNANQYSNIVDSQQQSIEAFKRQKGYLSGYLQNRQNIFDRTTNETSVAFRVVEDNLPIFLNNQMILSRFLNTIADKNTLLTQIKSAIEKLGANINFETFFELDYFNRTLSQSGIEKYNLLISGKTTDQNTKLKGINELIKEYIDQHQGEKLKKIKLKKLYKQILSESTTNSFAFDIIDTNEDLMEMIGNFLQLTYERVKEKISFLEKIESLKDHNQNSTIDLPQVYIERRNLKRLSSHVFKEFDFIEQKLEENFVVQFSGKLTKKALDSYRKKQNLSLQEVYDGLQDIQYEVNGNNVPAQDLFLSGIPDFIYHGLDCHLQNLLEKAQSENLLFQEISQLQPKNIEQNSFNHPTFDQKSISGIKEILDFYKTFQVNLSLFNMNREDGKVELDPEFYSDFDELYSDLREIIPIYNKARNYLTKKPFSTEKTKLIFDSPQLLNGWSKSKEQDCLGTIFKKNQKYYIGVIDSQTKAKDNLFEPYNFPELLQDQDCYEKMNLYFLKSPNRDFPHKYISKKGGKKYPIPAELRKKYEYYRQDKNKDEQKEDLAYHHELITYYQNCLSKDEEWQVYNFKLKDPKSYANVSDFLADLTPNTYRMDFTKIPESYIKKLVDDGKLYFFQLYSKDFSENSKGKPNLHTLYLKAVFDQINAEKFNYSYKISGEAEIFYRPASLEYKVTHEKNKPIQNKNKNNHKKESVFAYDLYKDRRYMMDKFFLHLPIELNRTPLHSKDSVINQEVNQIVKLRSKNYFLGIDRGERHLIYLTLIDEDGKIIKQQTLNKISNQYKNQNGETETVTTNYHDLLDAKEKQRKESLQEWQTVENIKELKAGFLSNVVNEIGKIIAEYQPVIMLENLNTGFKNSRIKIEKQVYQKFEKALIDKFNYFIRKDLDPESVGGLYHALQLTKGYSKQYNGKQNGIIYYIPANYTSNIDPTTGFISSFIPTRYENIEKTKDLISKFNSISYDEQEDLFCFEIDYQKIRPDTKLWERKVWQIYTYGDRFDTYRDKNGQWISDPVKPNEKFKQLFNEYDINLGQDLKQQILSQNDADFFRQFLRLLKLTLQMRNSKTATGEQDIQSSIRDNDYIISPVKNSRGVFYDSRRDYKDWPENADANGAYNIARKGLIMLKNLKSGVDEKRICDISTENWLKFVEGISEGD

SEQ ID NO: 240 - protein, 1323 aa, unidentified
MSKKDFSQFTNKYSLSKTLRFELKPVGKTLEMLRENNVFKKDEIIQKKYEQTKPFIDRMHREFVLEALNSVRLSGLHEYQKALQGWQKNKKDKEVQKELQKNEKALREQIVILFNAQAKRWHEKYSGTKKNTTEILKEKDVFTAILKKKYGEEKDSFVLDERGGFVLDSQGEKVSIFDDWKNFVGYFDKFFKTRENFYKADGTETAIATRAINQNLKRFCDNMEIFNKLKDKIDFSEVEKDFSFEPTIVFSLDFYNECLLQSGIDKYNEFIGGKTLENGEKLQGVNELINQYRQDHKNEKIPFLKKLDKQILSEKDKVLIDEIEDDNELYVKLKRFYEVSGQKVNILKRLFADFDKNNEQYDLDKIYISKEAFNTITRRWTFEGKMFEKELYEVISQKEVKAIYEALRRDKNDSAIKKQKDGYKFPLFIRLSHIKQALDTIEEGGVYAGKGNKEKSEKYFWKDFYVEKITTLGNKTIWEQFLAVYLFEFNHLFEREVIVQEKTIDGKKKQKNLKVGLDVFSKELKNKLDNFEKENTKAAIKNYADEVLHIYKLAKYFAVEKKREWLDHYEFDPLFYNHVEYGYEIFYNEAYEEIVQVYNKLRNYLTKKPFSQEKWKLNFENATLADGWDKNKERDNTAIFLRRGNKYFLGIMKKEFNNIFSDHCKDVFLANENEEYFYEKMVYKFFPDQAKMFPKVCFSAKGLLEFKPSKEICEIYKNAEYKKGDTFSVSSMHKLIDFYKDCLRQYDGWKNYQFKHLKPTQDYKDNIGEFYRDVAEDGYFIDFQKITQSYVEEQNRDGKLYLFEIHNKDWNEKTVGVKNMHTLYFESLFSKDNQRRNFPMKLNGQAEIFYRPKTKTLEKNKIITKKNKKTLEKGKKAWHKKRYLEDKIFFHVPMTMNRIANNSFGFNREINNFLAGNPDINIIGVDRGEKHLAYYSVINQKGKVLHSGSLNKINEVNYAEKLEERARNREQARKDWQSVENIKDLKKGYISQVVRVLADLAIKYNAIIVLEDLNMRFKQIRGGIEKSIYQQLEKMLIEKLNFLVNKKEIDPQKAGHLLRAYQLTAPFESFKDMGKQTGIIFYTQAGYTSKIDPLTGWRPNLYMKYVNAKNAKDLILKFDSIVFNEDKNRFEFAYDLNRFFPNAKEQPKKTKWTICSCVERFWWNRKLNQNKGGYDYYENLTDNFNELFREREIDTEQNILEQINNLNPEGNEKFFKDFIFFFNLVCQIRNTDQEEAGDKNDFILSPVEPFFDSRNAEQSGKGLPKNGDENGAYNIARKGMIILEKLATYRVEHGDCDKISWGDLYISNQEWDNFATQSTFLKN

SEQ ID NO: 241 - protein, 1462 aa, unidentified
MQKQIPTENSLSQFTNQSSLSKTLRNGLVPIGKTASWIKKHDIIGSETKDGETTLVGVDARKASAYFACKKLFNKLHSLFIQDLLSIDASSTNAIELQEALQSLSESDELEISKDLEKTFKELMDKQAEEWIARYLVEMPKHWQKDIDELQSIIEKESNNQKKKTLQNAINKIQKKIDKPTVKKSGISALTSNTEALQLLEWQVCEGKIDATGKELKLNSSEEGLGAKVLTRIIRQFDGFSSYFTGFNENRANVYDPKGDKTSIIHRCFLENFPFHLNNIKAWETIQKKLADAPQDVQDQWQSSLKNCQEELNFSTDTFFTIEAFINFLSQKGIDRYNDILGGGSSQTDGKEKRLGLKQIINLTNQQLDKKTKLPKLQQLYKQILSPSDHSFVESFENDQEIFDKVTEFHNRLFIEKNDKGLNYFEAFFQEFSDSCQSHEDNKNNIYISKDKLSHLSLTLTGSWHSLNDLLIKLYDKPEKVGKQSQFSISEIEDALAQELDGESAAGKINEAYRSNGKNTLYSFFSTRFQELYQAAQNSWSMLVENGILGETKIDERRDDEGEKGFDQIAAIKSFLDATNHIAGFAKDLTLPGKKRPKDFCADWQNQLENFRHGLAIIDLYNKCRNHVTKKPYSTDKLKINFNNATLLDGWDRNKEPDNYGVLMTKDSKYYLAIMTPSSNKVFDYDSSAKGSPKVKAKRDELAKAIIADSHEATYQKVNYKLLPGANKMLPKVFFANSNKELFKPSAEIIKIKEEKLYSKAEIEKHGIENLHKYVDFCKASLAKHPEWSQCFDFDFSATESYQSVDQFYREVEANGYKLSFDSIKESYIDEKIENGELYLFQIYNQDFAKGKRTDSKDNLHTMYWKAVFEEENLKDTVIKLNGQAEIFFRPASLDKKKVAVHKVGEVLKHKSFGQTWKHKLNSPVQKVITLDELKKTDLYKDGKVSIKRNEETQYDDIHFEGEVIGKVCRHEIVKNRRFTEDKFFFHCPITMNFQAPAIAGNFNKKVNDFLRHNSDVNVIGIDRGEKHLLYLSVIDQNGKIKHQESLNAIDGYKGTEIKYHEKLDEVEKNRDKARKSWSLIENIKELKAGYLSQVVHKLAELIIKHNAIVVLEDLNMGFKRGRFKVEKQVYQKFEKALIDKLNYLVFKDKQSRLEAGHYLNAYQLAAPFESFQKLGKQTGILFYTTASYTSTTDPVTGFLKNVYHSYSNVEDAVKFWQSFDSIVYNEEKNRFDFTYTVGKIKNKNANKEKDEDKVEQKTWTVSSSVTRSRYVKAQVPQTEEQKQDTSSEEIGKRGGHECFFVTHELKDLLDQNSIDYQTVTNLKAELIKHTAKSHSSLHKSMIYYFNAILTMRVTDDKADKGSDQNDFILSPVEPFYDSRKAPQSLPENGDANGAYNIARKGLCILDKINQSKAEDKKVDLLIRKSDWQNYCQSKAVVKAQTAKMNEITVEAKLLDPKEVKK

SEQ ID NO: 242 - protein, 1292 aa, unidentified
MVSEKENTPTFNSLTNLYSVSKTLRFELRPQYSTLDHIKDDQIVDKGEELKNHYKTFKKILDQVFSRIINDSLDKTYLDQKYISTYQDLVFKHRDRLTDKDRAELKALKETLKKQIDKSLDHKDKKAIFSDPVNFLIDNESDFADLIGDNRPSIEAFNRQKGYLSGYLQNRANIFDHTTNETSVAFRIVEENLAIFLNNRLTLQHFFEKVADKDGLLKFLQETLSQLGFKLKLEDLLSLDYFNRTLSQPGIDQYNLLISGKALEDGKKMQGINEVLNQYLQQHQEEKLHKIKLKQLYKQILSESKTESFTLDFVEDNKGLAAMLLQFIDFVNKLIEEKMLLLDMIQGLKDSSVSSEFLSRLYLERKNIKRLSNFIYKDYGYIEQSLEENFLSTIEGKITKKALEEHRKQDAFTIHEILVALQKQQYEKDGALESADHLLLPGVVDFLYQNLDCKHSTLLEKVGSEKQPLLDLFNEKQLLEGQDAESHASKYSDRPFNDHEIKVVKTALDFYKNLQSNFAIFQIPDENLKLDSEFYSEFDEFYQGLKNIIPVYNKSRNFLTKKPFSTEKTKLIFNNPQLLDGWSKSKESDCLGTIFIKDGKYYVGIINSATNAKNTLFEPYNFANFDQKQYFEKMNLFFLSDLKRDFPKKYFSEKWHNQHPVPADLREKYDYYRIDEHKDERKNDLKYHHQLIAYYQDCLKKDTEWQIYQFKYKAPEEYSDVNEFLSELTPNTYKMEFNKIPAEYIKKLVDDGKLYFFQIYSKDFSEFAKGKPNLHTLYLKAVFDQKNAEEFNYNYKISGSAEIFYRPASIETRVTHPKNQPIKNKNKNNPKAESVFQYDLCKDRRYMSDKFFLHLPIELNRIPLLANDSSVNSMVNQVVSSRNQNYFLGIDRGERHLIYLVLIDQNGRIIKQQTLNQITSSYQEKANNQTVEVITDYHDLLNDKEKLRKKNLQEWQSVENIKELKAGYLSNVVNEIGKIIVEYQPVIMLENLNTGFKNSRIKIEKQVYQKFEKALIDKFNYFMRKDLDSSAIGGLYHALQLTKEYSKQYNGKQNGIIYYIPASYTSNIDPTTGFISAFIQTRYENVEKTKSLIEKFNDITYDAEESLFCFSADYKKFSPEAKLWQQTIWQIYTNGDRIYTFKNKEEWQSKSYILVEEFKDLFAKYHIDYCRDLKAHILSQTDASFFKQFLFLLRLTLQMRNSRTTELNGTDADTKKRENDYIISPVKNQYGKFYDSRKDYVDWPENADANGAYNIARKGLIMLKHLKEGLPEKRICDISTEEWVQFVEELNK

SEQ ID NO: 243 - protein, 1292 aa, unidentified
MVSEKEKTPTFNSLTNLYSVSKTLRFELRPQYSTIDHINEDQIVDKGEDLKNHYKTFKKILDQVFSRIINDSLDKTYLDQKYISTYQDLAFKHRDQLTDKDRAELKTLKETLKKQIDKSLDHKDKKAIFSDPVNFLLDNESEFADLIGDNRPSIEAFNRQKGYLSGYLQNRTNIFDHTTNETSVAFRIVEENLAIFLNNRITLQHFLEKVADKDGLLKSLQETLFQLGFKLKLEDLLSLDYFNRTLSQSGIDQYNLLISGKTLEDGAKLQGINEILNQYLQQHQEEKLHKIKLKQLYKQILSESKTESFTLDFVEDNKGLAAMLLQFIDFANQLIEEKMPLLGMIQKLKNSSASSEFLSQLHLNRKNIKRLSNFIYKDYGYIEQALEENFLSTIEGKITKKVLEEHRKQDTFTIHEILVALQKQQYEKNGKLEPADQFLLPGIVDFVYQNLDCEYSALLEKVRSEKQPLFDLFKERQLLEGQNTESHASKYSDRPFNDHEIKTIKTTLDFYKHLQSNLAIFQISDENLKLDSEFYSEFDEFYQGLKNIIPVYNKSRNFLTKKPFSTEKTKLIFNSPQLLDGWSKSKESDCLGTIFIKDGKYYIGIINSATNAKKTLFEPHNFANIDQSQYFEKMNLFFLSDLKRDFPKKYFSEKWHSQYPIPADLREKYDYYRIDEHKDDRKNDLEYHHQLIAYYQDCLKKDTEWQIYQFKYKSPEKYSDVNEFLSELTPSTYKMEFTKIPAEYIKKLVDDGKLYFFQIYSKDFSEFAKGKPNLHTLYLKAVFDQRNAEEFNYNYKISGSAEIFYRPASIEARVTHPKNQPIKNKNKNNLKTESVFQYDLCKDRRYMSDKFFLHLPVELNRTPLLPNDSSVNSMVNQVVSSRNQNYFLGIDRGERHLIYLVLIDQNGKIIKQQTLNQITSSYQEKSNNQTVEVVTDYHDLLNDKEKLRKKNLQEWQSVENIKELKAGYLSNVVNEIGKIVIEYQPVIMLENLNTGFKNSRIKIEKQVYQKFEKALIDKFNYFMRKDIDPSTIGGLYHALQLTKEYSKQYNGKQNGIIYYIPASYTSNIDPTTGFISAFIQTRYENVEKAKALIEKFNDITYDADEPLFCFTVDYKKFSPEAKLWQQNVWQIYTNGDRIYTFRDKEEWQSKSYILVDEFKDLFAKYQINYHNDLKTQILSQTDAGFFKQLLFLLRLTLQMRNSHTTDSNEADIDTKKRENDYIISPVKNQYGKFYDSRQDYMDWPENADANGAYNIARKGLIMLKHLKEGLPEKRICDISTEEWVQFVEELNK

SEQ ID NO: 244 - protein, 1278 aa, unidentified
MPKLSEFNVKFRKQITLRNELIPVGNTLFNIQKNKIISKDQELADKYEKAKLILDDFYRYFINTALSDIKLDWSDLADALLSKKIQSEKRKQIIDCFTKTSLEFENKFEKKEEKVKITYSDLFKGSELFKKKKIHNFIFQIYQNNEVFEKLEIIKAFENFSSYFLGFFDNRKNIFSADDKTTSIAHRIVDINFSKFLQNCEVVKKLRKFCPQCIEKAEKILANEGLNDSVEHVFSLDNYNCCLTQEQIDLYNKYIGGIPATVGKEKVKGLNEIINNECQKNNDLNEILKKNHASTLTELYKQILSDRKDKFILDEFSSGTDAIEAVKHFYEDQMGNNGAIPLLLNLFKNFDKYDLKYIYVNKSNLNFLSTYLFGGANWNFLSDAITKFNKKLASIKDISVDDLNSAYVNVDEDKSESITSLFYKSFEKKIGALLAENCINWPEALKNANDKHFIKDKLDSLLDIFKLSKVFITDVFNKDFSFYVDYERALQKLEEILSLYNKVRNFATKKTYNIDKIKLNFECYQLCSGFSESKEYDFLGVFFIRGDKLFLGILKKGNKDKELFSEEKSKNEERAFQKVRYYLFDQFNKNLIKCSLALTEVKKHFKSSSDDLVLSDSFSPSLKITKDLYDIYTEGKFKADYAKKDAADYRCCLKKWIEFAISFLKSYKSTKNVFDYKDLKKAEEYVDVKSFYEHVDRLNYKMDFIPFSSKYIEQLINDNKLYLFQIYNKDFSLKSTGSKNLHTLYLKNIFSSENLKSVVIKLNGGAELFYRAKSIETSDACAHTADSILVNKDYLVDSVYKHIPDQIYEEIYKYKNHKIDVLSDNAQKFFSENERLIVTKTATHEIIKDKRFTQDKFFFHLPITLNFKEKDKIDSFNKEVLTFLKNNNDINIIGIDRGERNLIYATVIDQKGNVLETKSFNLIKQTKNDNNIVQIDYNSKLKTRENARLEERRSWDSISKIKDLKEGYLSSVIHQLSCMMIKYNAIIVLENLNSGFKRIRSGISEKSVYQKFEKMLIDKLNYLVFKNVDVFDKGGVLNAYQLTDKFSSFSKLGAQCGFLFYIPSAYTSKIDPETGFADVFNFSCLKNNKSIKEFFDNFQSISYDKSEDLFKFSVDFSNKKISLRAEMFKKKWDIFSYGKRIIRRKINNFKTEIVDPTENLKSLFSSNNIDFENGNNLISLLNDKIYKKLLDIFKNILQMRNSSESEDYIISPVKDKNEKFFDSRISEKIHDGDSNGAYNIAMKGLMILKMNNDHAESKKFFISNQEWFKFMQDGSFRK

SEQ ID NO: 245 - protein, 1291 aa, unidentified
MENKNCNFDKFTKQYQVSKTVRFALTPIGRTEEHIIEKQYIEAAQRKDQAYKILKPVIDKKLCVMIDDVLTHCEKQDWEKLNELTLQYQNDKTSVEALGEQQDKIRKNISKEFENSIEYKNFFGKDSEKLFKTFLPQCLEEINASEADKEAVKEFQKFKTYFNNFLTVRKDIFNDDSKQNTIPYRIVNENFMIFAGNRKTFSNIVKLIPDASAEIAKEGIERQEWEFYDVQNIDSWFEPDSFQQCMSQLGIQKYNFIVGLVNSYTNLYIQQHPEALEVKRSRLKLRMLHKQILSDRTNPSWLPEQFAEGEEGEKQIYEAIQSLEDDLNKNHFQEKFDNLLQLIDTENPRIYIAASEMPRVSSALNYGWNGLNNVRKNVLQELNSEAKIEKILKQDVSLNELSDALNKYADIYKKEQVPTLQQYIEYGKELLQDCAVACNDYHASIRNNVERLNQNEKLIEVLKTYLDCYQRVMHFMNVFVVGDELDKDVDFYAELDELIEDISQIIPLYNKVRNYVTRKAYSLDKIRIMFEKSDFLGGWGQDFDTKKALIFEKDGLYYIGIIEKKYTNTDVQYLYEEIEEGNKAVHFVYNFQKIDNKNFPRIFIYSKGTNYAPAVRKYNLPIQNIIDIYNERKFQTDYKKVNEQEYYESLEKMIDYFKDGIMKNETYRKFHFNWKPSNEYENIKEFYDDTDNSCFLLEKEEINFNHLKEQADQGKIYLFQISSKDFNKGSTGTPNLQTMYWRELFSDQNCKEGIIKLCGGASIYMRDVSIKQPIIHKKDSWLINKWYMEEGQNKVIPDDTYVKFSQIVQGRMSEAELNVEEQQLWNSGLIQKKKATHDITKDRRFTRKQYMLHAPLIINYKQQDIPTPRRFNEEVRSFLKNNPNINIIGIDRGEKNLIYITVIDQKGNILSGMQKSFNQIEEKGANSRIVDYYGKLQSVEDRHTEARKNWKQIGTIRELKEGYLSQVVHEIAQLMIQYNAIIVMENLNMGFKKGRMKVEKNIYQRFEKMLIDKMNYLAFKKNIEGKAINPYEIGGVMNGYQLTNKFTNFADMGSQNGFIFYVPAAYTSVIDPVTGFVDVFQRAEFKTGDFLQKFEDISWDDKEQSFVFTFDYQKFKCNGTCYQNKWSLYADVNRIETVKKNNQVYRQEQCNPNQRLIELFDSKGIAYRDGHNLVNDLENYDSKLLSDILYNFRLILQLRNSMRDYSTGEVIDYIASPVMYHRERFNSQKKNPSLPLDADANGAYHIALKGLMCLQKINEYADPDGKMDIKNMKITNEEWFKFMQTRRESNV

SEQ ID NO: 246 - protein, 1294 aa, unidentified
MKSIYEDFIGLESKNLTLRFALKPEPKTEENLKQYWDKLRDEERAKAYPIVKKILDREYQRLISEGLKSLENQNALDWTELAEYIRTSSLNKKKNEEKRLRKLIAQSLKAHPLVDKLKVKNAFGKNGYLETLPLGKEEKEAVKVFAGFGGFFNSYNKNRENYFSTEEKSTAIANRIVNENFSKHFSNVEIVTKIQKEVPELIQIVEAQFKGYDAIFTVNGYNTALSQAGIDTYNEMVAIWNKEANLYAQKAGKLPDGHPLKKKRNYLLSALFKQIGSEKEHLIQIDRFDGDEEVIEALTGVKKMLQEADVFEKLNMLVEDMENWDYSKIYLSAQSLSNVSVFLNNLYEDERENSWNYLDNVLREKWQIELQGKKKGTDLEEAIRKKKQSFYSIEELQEAVNAIEETDKCYNVSKWLLGAMKSERVIEEKKKDVEDFCTQWKNERNSLKETDITALKEYLEQWIFLARYCKSFYANGIEKKEKDEAFYHILEDVLYVLDEVIYFYNKVRNYVTKKPYSLEKMHLKFGHNELANGWSVNKEGNYGTAILRRNGKYYLAITNSLNKKMSIPTQLESTGNNYEKMVLNVFPNVFRMIPKCTTGRNDVKSCFERKEPNEYFFIDTPEFVNPFKVTREEYELNKITYDGVKKWQSDYSKNTQDEKGYKEAVTKWIQFCMRFLQSYKSTAIYDYSTLQQPEKYETVDSFYHDVEKILYECHFEYVPANKIEQLEEEGRIFLFQIYNKDFSENRRPDSKKNLHTLYWEALFSEENRKAKVIQLNGKAEIFRREKSIEHPIVHKAGEVLVNKRTKDGEPIPDDIYKDLSNYFNGRNVTSEKEEYKECLDKVYTSTKKYDITKDKRFTETKYEFHVPITLNYQADGVKYLNQKILHVLRDNPDVNIIGLDRGERNLISYVVLNREGKIVNNQQGSFNIVGKMDYQKKLYQKEKNRDKERKTWKNIETIKDLKEGYISQVVHELTDMAIRNNAIIVMEDLNFGFKRGRTKVERQVYQKFELALLKKLHYLVTDKTEGEAMLKPGGVLQGYQLAREVKTLKEIGKQCGCVFYVPPGYTSKIDPTTGFVDVFNMSGVTNREKKKAFFEKFDNMFYDEKRDMFGFSFNYEKFTTYQSSYRNDWTVYSNGSKYVWNSLKRTDELIDVTKELKLLFEKYAIDYRNEALFEQIMSQDTDKNNADFWNKLFWYFRVLLRLRNSSDELDQIVSPVLNQNGEFFETPKKITEKSYLSDYPMDADTNGAYHIALKGLYLIQEKIADESVDLDNKLPKDFYKISNAEWFMFRQKEK

SEQ ID NO: 247 - protein, 1325 aa, unidentified
MAEKFENFTKLYPVDKTIRTKLIPVNSSLKNCDMDDFLAECDYMNKEQEKRNYITDDEKRAKDSVRAKALIDKYHKHFINETLKNFQNYDKEFVDKKKKDLKDPNSVSYWDDLLTQYYDVYKTDSTNSANADDVQKSLRERIAEIFKNKEDFKTLFGADLFKGKLETFLGSINTTKEDMELIKSFKSFVTYFSTYNTNRQNMYSADKKATAISYRIVNENLPKFIDNIRIFNKLTSCTTVQEFVLLAEKNFTDQLKVLNTPKIGDIFNISNFCNTLTQEQIEAYNAIICGKVENDTAKGINQFVHEYNQGQKETKLPKLKALYKQILSDRVSISWLPKKFENDQELLSALEKSHSDFHRNIVNENTLGKLLCKLSEYNSNGIYITQKQISLISKKMFEDRMFIADAIEEYYLEAFRNTQKPKENEEKYAERINKFLSKKNSFSIAEIDKSIAFKISNTDDEKVKGCFKTIGAYYANLETPKGKNIGQDNIFGQISLAYKSIEFLLKNYASKSNEKKLFQDKTSKKLIQDYLEKVLQLIRFVKPLAGKEFGSNKDETFYGEFTPIWEELNKFIPLYNMARNYLSRKPYNEEKIPVFFGHNGTFLNGWPDSKTDKSDNGTQYGGYLFRKKNSIGEYDYFLGISTNSKLFRKKPIDNNVDFMERIDYYQIKSKTIFGKSYIGNYSKDTEILKSAIENFVSSKSLQEEYLFKDNETICAFLKRLKDKDIASYKEILNETHCSKAYNDLKEHILQTLASLNRVKKAQELSKHKEYDLIRIYEEIQSMPSALFSYFKVSMNDIEAAMSASKKRLYLFKISNKDLSYAETSSQGKRKSRGRENLHTMYLKALLDGNKAFDIGSGSIYFRRKTDFGYTKETWEKGHHYAELKDRFSYPIISKRRYTVDHLQFHLSMTINYNADKNCKNINEMVNETIRNGAIEHIIGIDRGERNLLYASVIDLHGNIIEQCSLNVIPNKHNDLGTDYLKLLKERESIRQEERRSWDSIEKINELKTGYVSQAVHQVVKMVLKYHAIIVLEDLNEGFIRSRQKRERTVYAQFEKQLIEKLNYLVDKGIAEGKPGSATNGYQLTNPTNNNVKSNQSGILFYIPAWNTSNIDPTTGFVNLFNLRYQNREKTREFFDKFKSIKYNSEKKWLEFTFDYNDFTSKGKETQTIWTVCTYGPRIEAHKDSPKIWKKKTVEDINNKWLGFFNKWNITISEDLKEQIVKQDKQEFYKHLLDLFKLTLQMRNSDDKDDYIISPVMNTAHKFFKSCKDDTTLPIDADANGAYNIARKGLMWIKQMKDYKDTKKFKPDLKNRKWLNFAQQKPYKDE

SEQ ID NO: 248 - protein, 1211 aa, unidentified
MKNIDKLTKQYSLSKTLKFSLIPIGKTLENYKSKDGLTSELILNKKVKNIKKYISECLFKLNDYALSQNTNLKNLNKYADLYFQNSTDIKKVELDLRKEIANILSPAHKKMLKRKEFVSVIVPSYVDDEDKKNEILEFSKFTSHFTDYLNNCENLFAVDESTGAIPFRCINDNLPRFLDNIKIYNKVIKCINDTEFNTFRNNYLGIYDATVNNMFTVDYFNFALSQSEINVYNDVVERINNYINLYNKSGGYNNRLPHLKTLYKQIGSKIDNQSILPPKFKSDNELLKTLYDYYNNDNKEKKFTSLKTVFNKLENIFSYLFEYNLDGVFIKCGNVLNTLSILMFDNVSMLKGLLKQENYNGKSISISQLQNIIDNSEIDNIKYQSIVDCYKNRFNFLLNKVFELYNKISILLSQNYQKTKKLKNCKQDMSLIKGFLDSIKNLEKFAKLLIGTGKENNKDELFYDDYSSLINQFYGFDVLYTKVRNYFTQKSYSLDKYKLSFDNPQFMEGWAKNQETARSVQLFTKDGLYYLGVMDNECRKNFKKPYNNPIDNDDIITKIVYEQIPNPSRIIQNLLFIDDETVKKNGKKNSEGINTVLEELKNKYLPSDINKIRKLGSYKITSDNFNKDDLSKYITYYIDRVKDYYNKYNFTFKSPSEYSNFGEFTNDIDNQAYQITFVNISFQQLMSLVDKGELYLFQIYNKDFSSFSKGKENLHTMYFKMLFDERNLADVVYRLQGGAEMFYRPASIDEDDVIIHEANKFIAKRTYEDKINDINNPTDEEKSKYYSIFDYDIVKDRRFVQPQFSLHLSVGINSKLPEYCNLNNTVRTIIKKSNNYNIMGISRGVNNLLFTVIVDSKGNILHKESFNIIKSNYNNNNYNVDYFDKIEKRNDENQKAKQDWASIEKIKYIKRGYISQVVQRICELIVEYDAIVMMESVNSKEDSTKLINQNIYKQFIALLENKLNYYVDKNTDMAQCGGLLNAYQLTNKIDNNSYNLIQNGLVFYVNKAYTSVIDPTTGFVNKLFPQYRNIEKAHDFISNIDDICYNQDENYFEFDIDYKKFGIDMPRKKWTICSYGNRIKSYSQSGCEEISLTDEYKNIFNNGEISYHKNIKEQLLNSENKSLLEQFINIFKLNLKIKNYSRGLSYIISPIKNKNGDFYFCRNEDIDMYDTYNMTCKGSIILNKIKKSDDINLIDLSIDDNEWFSCIQNII

SEQ ID NO: 249 - protein, 1161 aa, unidentified
MSYNREKMEEKELGKNQNFQEFIGVSPLQKTLRNELIPTETTKKNIAQLDLLTEDEVRAQNREKLKEMMDDYYRDVIDSTLRGELLIDWSYLFSCMRNHLRENSKESKRELERTQDSIRSQIHDKFAERADFKDMLAAPIVTKLLPAYIKQNSKYSERYDECVGILKMYGKFTTSLKDYFKNRENIFSKEKKSTAVGYRIVEENAEIFQRNQNAYDRICKIVGLDLHELDNEITAYVDGRTLKEVCSDEGFAKVITQEGIDRYNEAIGAVNQYMNLFCQKNKALKPGQFQMKRLHKQILCKGTTSFEIPKKFENDKQVFEAINSFTEIVTKNNDLNRLLKIAQHVNDYDMKRIYVAADAYSTISQKISKKWNLIEECLMDYYSDSLPGKGKSKETKIQKAIEDEKYRSVSQLNEIIDKYYVEKTGQSVWKVESYISSLAETIKLELCHEIENDEKRNLIEDDDKISKIKELLDMYMNVFHIIKAFRVNEVLNFDETFYSEMDEIYQDMQEIVPVYNHVRNYVTQKPYKQEKYRLYFHTPTLANGWSKSKEYDNNAIILVRDGKYYVGIFNTKSKPSKELIKGHLSESDNDYKKMNYFLLQRPHMNLPHVFITANHDFYKPSKYILDNYKKGKQVKSNKNFDIQFCRDLIDYFKECIKKHPDWNKFNFEFSATETYEDISAFYREVEKQGYRVEWTYINSEDIQRLEEDGQLFLFQIYNKDFAVGSTGKPNLHTLYLKNLFSEENLRDIVLKLNGETEIFFRKSSVQKPVIHRCGSVLVNRTYEIAENGTTRVQSIPESEYMELYRYFNSEKQIELSDEAKKYLDKVQCNTAKTDIVKDYRYTMDKFFIHLPITINFKVDKGNNVNAIAQQYIAEQEDLHVIGIDRGERNLIYVSVIDMYGNIVEQKSFNLVEQISSQGVKRYYDYKEKLQNREEERDKARKSWKTIGKIKELKEGYLSSVIHEIAQMVVKYNAIIAMEDLNYETIQGYRNRHRILKPGHPFERLNDAEYLRSIGAAAISREDKELHPTAAGMLMFGNEYNIVRHFPEYFLDYREMLDPTIRWTDRIQSSSGDWSGNLCDFYFRVYNKISLDIKIPFVLQGGDRIEDTPVHKALREALANCLINADYYGTRGVIIKKEPRRIIFENPGYIRTGKIRIQEISH

SEQ ID NO: 250 - protein, 1309 aa, unidentified
MTEIALIIVLGIFAQWIAWKWRVPAILPLILIGLIVGPVSQLWLGGEKWIDPLYEGEGDHQGLFLQNSMFSFVSLAIGIILFEGGLTLKIKEIQGVGRAIGRLITLGSLVTFIGAAVAVHYLCLLSWDFSFLFAALIIVTGPTVIAPILRNVPLNRNVATVLKWEGILIDPIGALAAVLVYEFIIASLGGEGIGHFSQEAFITFVNVLAVGVFVGVSAALLLKLMITRDWIPHYLLNVFTLALVLLVFVMSDAVAHESGLLTVVVMGMTLANLKVPNLKEILDFKESLTILLISILFIILSANIDIAELQAAKKQWTVYQTTLRKKLVTVFQDKADLFGKKLLSDFLPRFLQEQGSWGQHRELVKSFDKFSTYFSGFHENRKNMYVADDKATAIANRAINDNLPKFFENILVHQTIRDSEHASAINLEHSQQLLARFGVDSVSDVFTPGFYLKLFSQHGIDAFEELIGGIKADDSDAQHAESVVGINQNINQYRQQFNQTNSEAKLTRRSFPLMVRLHKQILATSNTTSFSYEPYTNDAGMLADLAKLVDEYDINEGFFSNLKQIMQQLKGADSSTIFIRSNALSQLSYAWLNNHAILPRAFAYHVEISSDFTTKVSKEKQLKLVDNSAKTKTVGLFSMADIEGWLAQLMASQDADSNALIIAAQQKKGTTLSHYFHQTFDAQLASMNKPFEQLLKELSVILNQSALDANRRPPQTNGVDDVGGQGFLQVVTIQQYMEASLNLLNVFKPLHLVFKRKEVEAPEQQDKGFYNEFSTLFTLMSDGLLTVYNKTRNHVTKKPYKSEKVKINFENPTLLLGWDANKEKSNSCVLFEKQGNYYLGVMHPKHRALFDYVIGMDELGKEKIVEKKNKLRESIITEAEGYKKVIYKLVPGVNKMLPKVFFSASRVGFFAPSEEIHRIRNTASFSKHGAPQKEHQKADFNLSDCHTLIDFYKTSIERHYEWRQFNFVFSPTSTYQDISQFYKELQDQAYRIEFDTINPTYIDQCVADGKLFLFQIYNKDFSPFSTGTKNLHTLYWLGLFEADNLKDVVLKLNGEAEIFFRRHSIKQKDAIVHQANKPIDRKNPAQAGQISQFKHDIVKDKRYTKDKFFFHVPITLNHKAKQSPRFNDAINQAVTTDTNVIGIDRGERHLLYYCVVSSHGDILAQGSLNTIKPSGGGTPVDYHHKLNAREKQRDAARKSWTNVENIKELKAGYLSQVVHKLTHLMVEHKAIVCLEDLNFGFKKVKNVPIGVGEFGVNNVNSGTTTKGDFTKSFAEKLGFSLTGADPVIFTIIFCVEKIFMFKIVWMPYI

SEQ ID NO: 251 - protein, 1248 aa, unidentified
MVKEIFYLLFSKKMKSDFFSPFTNLYPIQKTLRRELKPLNENFQHDPALTALRNSEILQRDEQREKDYQAIKPLLDELHNQFITESLQSLEPQDRSDFVDFYQNYQKSKKNKANLSEKELKSLDEEFESRTKALRTAIGTSFSNTAELRKSNPDYVNEKGKPFLDQKSYKILTEAGVLWLLEKKYASDPEKLALIRRFGNFFTYFTGFNQNRENYYATDEKATAVAYRAINENLLTFANNCELFEKLSVLSLSEREKKIFNPDSYSEYLTQSGIDFYNEMFANIRSKANLYTQEHKTKLPQPKLLYKQIWSPRGNTIPFDLINKDEEFQKMLDTMIAETDQRIPEFKKLLEPIFEGKADLSQIFLSKTALNIISNRYFSSWHTLLEKGVELKLFKFKKNDEESFKLPAYLSLAELKELLEAVPFQTAEKSDTTEGNHHQASLLKLQRENLHLERSNSNWELLLKSMKSDFESFWTWEGEFWSYTSAKKALQSLSSLQSTNQEHKNLIKMLLDNTLYAYRMLKWFKVDTSKLGFVPEGEFYPSLDQILQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYGASDQVLELYAKGSFKKSEKSFNLADLHTLIDFYKSALPKYEDWKVFNFQFQATENYQDISQFYREVEQQGYLLNWRKVNEELIKQGIKDWSLFLFQISSKDFEGKSKTPDLQTLYWQQLFEFSTNVKLNGEAEIFFRPWSMKKEKKNLKVDNYDVFKHKRYTEDKILFHVPITLWFGNNEVSPSAPSKFNQKLNQELIIPHFDDLHVIGLDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSKEMKAQFFKSFKNLTRDTNQEAYIFDDGTWKLYSNVERRRGKRGDHRERTQIKYDPSLELDTLFSKYQIEKSESLFGQLKNRELPQTFWTSFFRILDLIMQIRNTDDESRDIILSPIGNAQERFDSRKRYDQLPRDEKGVVIEESAFEYPTSGDANGAYNIARKGVMMLERIKENPEKPDLLIRDAEWDRKITN

SEQ ID NO: 252 - protein, 1235 aa, unidentified
MKSDFFAPFTNLYPIQKTLRRELKPLNENFQHDPALTALRNSEIPQRDQQREKDYQAIKPLLDELHNQFITESLQSLETQDRSDFVLFYQTYQKKKKNKADFSEKELKSLDEEFESRTKSLRTAIGNSYAKLAELRKSNPDYVNEKGKPFLDQKSYKILTEAGVLWLLEKKYASDLEKLALIRRFGNFFTYFTGFNQNRENYYTTDEKATAVAYRAINENLLTFANNCELFEKLAVLWLSELEKKIFNPDSYSEYLTQSGIDFYNEMLANIRSKANLYTQEHKTKLPQPKLLYKQIWSPRGNTIPFDLINNDEEFKKMLHTMIAETDQRIPEFNKLLESIFEENADLSQIFLSKTSLNIISNRYFSSWNTLLEKGVELKLFKFKKNDEESFKLPTYLSLAELKELLEAVPFQTAEKSDTAEGTHHQVSLLKLQRENLHLESSHSNWELLLKSMKSDFESFWTWEGEFWSYTSAKKALQSLSSLQSTNQEHKNLIKMLLDNTLYAYRMLKWFKVDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYGASDQVLELYAKGSFKKSEKSFNLADLHTLIDFYKSALPKYEDWKVFNFQFQATENYQDISQFYREVEQQGYLLNRRKVNEELIKQGIKDWSLFLFQISSKDFEGKSKTPDLQTLYWCQLFESPTNVKLNGEAEIFFRLWSMKKEKKTLKVDNYDVFKHKRYTEDKILFHVPITLWFGNNEVSASAPSKFNQKLNQELIIPHFDDLHVIGVDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVVEPWSVTSAYQLAPQINTFWDIKWKQRGIMLYTRANYTSVTDPLTGRRKQYYFKKGSSEEMKAQFFKSFKNLTRDAGQKAYIFDDGTWQLYSNVERRRGKRGDHRERTQIKYDPSLELDTLFSKYQIEKSDSLLDQLKNRELPQTFWTSFFRILDLIMQIRNTDDESRDIILSPIGNAQERFDSRKRYDQLPRDEKGVVIEESAFEYPTSGDANGAYNIARKGVMMLERIKENPEKPDLLIRDAEWDKKITN

SEQ ID NO: 253 - protein, 1237 aa, unidentified
MTKPLFSQFTNLYPIQKTLRRELKPLNENFEHDPALSALRNSEIPQRDEQREKDYQAIKPLLDELHNQFITESLQSLETQNRSGFIDFYQNYQKSKKNKADLSEKELKSIDEEFESRTKALRTAIGNSYAKLAELRKSNPDYVNEKGKPFLDQKSYKILTESGVLWLLEKKYASDPENLALIRRFGNFFTYFTGFNQNRENYYATDEKSTAVAYRAINENLLTFANNCGLFEALQVLDLSLEEKNIFNPDSYSDYLVQEGIQDYNTQIASIKSKINLYSGAHKTKLPQPKLLYKQIWSPRANTIPFDLIASEAEFQEMLHTMIRETDQRIPEFKKLLAQIFEEKADLSQIFLSKTALNIVSNRYFSSWHTLLEKGVELKLFKFKKNDEESFKLPAYLSLAELKELLEAVPFQTPEKSDTDEETHHQVSLLKLQRENLHLENSYSNWELLLKSMKSDFESFWTWEGEFWSYTSAKNALQSLSTLESANQEQKNLIKMLLDNALYAYRMLKWFKVDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGAMEKMDYKLLPWANKMLPKCLMPGSDKKKYGASDQVLELYTKGSFKKSEKSFNLPDLHTLIDFYKSALPKYEDWKVFNFQFQATENYQDISQFYREVEQQGYLLNWRKVNEELIKQGIKEWSLFLFQISSKDFEGKSKTPDLQTLYWQQLFKNQTNVKLNGEAEIFFRPWSMKKEKKTLTVDNYDVFKHKRYTEDKILFHVPITLWFGNNEVSPSAPSKFNQKLNQELIIPHFDDLHVIGIDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSEEMKAQFFRSFKNLTRDAGQEAYIFDDGTWKIYSNVERRRGKRGDHRERTQIKYDPSLELDALFSKYQIEKSDSLLDQLKNRELPQTFWTSLFRILDLIMQIRNTDDEGRDIILSPIGNPQERFDSRKRYDQLSRDEKGVVIEESAFEYPTSGDANGAYNIARKGVMMLERIKKNPEKPDLLIRDAEWDKENNKLT

SEQ ID NO: 254 - protein, 1378 aa, unidentified
MPALPFEQFTNRYELSKTLKRELKPVWETGKLLEEMGIIAVDKKRKEAYDKVKPYIDKIHRKFIEVALSKVKDDLLFSEEVARYFSLYQNWKKDRKNSVLQKQLEKNEQILRKRVVSYFSEGVKTFLAGYPNMGFTKKTQEFLYEAPLFKLLKREYGNDQETLIPWETGDEVSIFDGWDNWLWYFKKFFETRKNLYKADGTSTALATRIIDKNLRIFLDNILIYQKLQEKEIFPKELQDTSSQIFDCSFYVNCFLQDGVLAYNRIIGGETLANGKKIKGLNEYINEYKGKTKEKLPYFKKLQNQVFSGDRLFIWAWIQDEVEFKDCLSLFYQASQKRVQYLQEMISQLWQYNDAQYAKIYLTKFAFENFTYQYVGGVKDVERAVYQAMKADNILWIAYKKSQNKYTFPDFIPIIYLKRALLSFPHQEHLWKERFYSEDILDISKSLWEQFCILLMEEFSSMMSREVEYNGEKKQIGYVSIAPKIVWALEDKQFSLSLELQKDVKEFADIARKIYIFGKKFACEKDRDRDVNIDLDSDFYIGEHGYIENFYENAYEEIIVPYNQMRNFISKKPRESTKKRKLNFEGVNLLWWWDINKESENLSVILRKENNYYLGIMKDSTIFERASKEVKKLSSDWCYEKMIYKYMKDVSLSIPKVSTQIKAVIQHFKKSDEYFILEKGSRVGKFVKPLVITKEIFELNNRIYRKEDLNSSIMRSELDGVDEEKGYVKKFQKEYLKLGGDPKVYRKALDSRIDFCKEVVASYPSCAYFDYSSLKPTSEYESLDVFYAHLDKLGYALSWENFSEEYIHQCIRDQKLYLFQIYSQDFSGGKKKGAQKNTHTLYFEQLFSPENAQAGYIFKLNGNGEVFFREATAPEKLWTKQDSKGKEVINHKRYAKDKIFFHFPIELNRVHGTLSAYAFNQEVNSFLAKNHSITLLWIDRWEKNLAHFSVIDQSWKLLESWSFNRLESYDKQGNLLLTAEKKIVEERDENWNITDYSLGKTWKQVPYIDYKLLLEYREKKRKIQRQSWKEVDKIKDLKKGYVAAVVKKIVDLVLKYQAIVIFEDLNMRFKQIRWGIEKSIYQQLEKALIDKLNFLVNKNETNPQKAGHFLRGYQLTAPFESFKDMGKQTGIIFYTQAAYTSKIDPLTWWRPNLYIKKQDAEKNKENICNFDRIIFDPIKKAFAFTYDLKEFVKSDQAIFPAKTQWTVFSAVERFRWNKSLANNKGDYDHYENLTDGKLLNRDKKEWEFCNFKELFGKYNIDIHSDILEQIHALPIKWNEKFFSEFFFLFSLVLQIRNTDPKGQGDHADFILSPVEPFFDSRKSAQFGVGLPTNGDDNGSYNIARKGIIILQRLQEQYLLLEGKVDLYITNVEWDDFIQK

SEQ ID NO: 255 - protein, 1012 aa, unidentified
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRKQITKAFEKNSLFNDLFKQNLIKKYLPGFDSVSEEEKKVVNKFSKITTYFDAFNKNRKNLYSGEAKSGTIAYRLIHENLPVFLDNIASFNAISGTGVNECFLGIETEFTDTLKGKRLTEFFQIDFFNNTLTQKKIDNYNYVVGVVNKAVNLYKQQHKNVRIPLLKTLHKMILSDRVTPSWLPERFESDEEMLTAIKAAYESLKEVLVGDDDDSLRNLLLNIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLSGWSDNQTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTNYKGLLTEREGERQDARRNWKKIANIKDLKRGYLSQVVHIISKMMVEYNAIVVLEDLNPGFIRGRQKIERNVYEQFERMLIDKLNFYVDKHYCPDKIQDM

SEQ ID NO: 256 - protein, 1237 aa, unidentified
MLDKFASLYPVTKTLRFRLLPQGRTEENMQAAKVLENDLERSEAAAVVKGLIKKYHLQFISDTLSGSTLSWQALTETLDKFKADHTATAELDSALAAYRCKLAELFTKSPKYKVMATPASIIKEILKTETDPENIAALNKLNGYTYIIFDYVSTRMLTYSADAKATSLAYRLVDENYLRFYQDISAAAEISAVLEEAGFDNAEVEAFIRTDYNTCLTSEGIASFNAAAGSINQFVNVLLQQNPVLESEPALRRHLQPLYKMLLDEAESKIIKFEDYGQLRDAVENFRRNFQDLPQSLIDIFAGRYDYSKIYVGYKYLNEASSQIAGGYNWKLLENALEDFYSKPYLVNGKMPVKYKTVVNKKMNQLAYSFTELQEALDAGESGSSITDLFGKYAELHAAYAAADGNVFYKEYDRKSIASLKNYLDAVNAIARFIKIFAVPEVYAKDEGFYGIVDGAADKLRDFDLLYNMVRNYITKKPYKKSKVALTFNSSSFGRGWDENKIYDELTTIFTYNGKYYLGVINKNDKPDLAAAVSKDEGGYKRMVYKTFDIVKQLPRLSFTKAVKAHFAESDEDFIFDGPKFAKPLRVPKEIYLQSFTDNGDKLPDSAKKYTKAYLDMSGDYKGYYEAIVKRIDYTKEFLSAYKSTSIYDLAFLKPADQYEQWSNFTDDVQTALYKIRWDNIPAAAIDEMVESGKLYLFEIYSADLYKNPAEGRKIDTQAQIFKEIFSENGQKVIKLLGNCEVYFRPASLPAVVTHPKGSILVNKQLVNGKTLPDEVYREIYRYLNKKSENLSPLAKQLLDKELVKYRVAQEDIIKDKRFTENQYSFHLPVTLNYKVKQQFYINMEVMNMLRSRKDINILGINRGTRNLLYVTVINQQGEILYSRSLNEFNGVDYRDKLLVKERGIKDAAMNWQAADSIKNIKEGYLSRALGEIVRLMVKFNAICVVENLSSNFRNAGGGIFAYGNFYKGFETNLIKKLNCLIIKDAEKDKAGSVLRSLQMTRSFESFEKAGRQSGWLFMLDPAYISAVDPLTGFVNLFSFRNLKTIRQKAEFLQKFKSINYVPETKAFDFVFDYKDFGVTACGPVSCWVATSDVERIVKTTENGKVKFESVLPSMQLAKLFTDKDIDFTDGHNLISEITADSRLVTETLSIFMNIMRLYNYDIDRNNDYVSSPVMGRFDTRYDKKLHNPDELAAYNMARKGLIIIKRAQASEKDSKVDLFIKNADFRRLRLFSRHSR

SEQ ID NO: 257 - protein, 1333 aa, unidentified
MKNFQDFTNLYELSKTLRFELKPIWGTKKLIEEKNILKLDKKKRENYEKVKPYFNKIHQEFINFALRNPNFDFSQFEEKYLNWLKDKKNKDLLKEKESIDKIFLEKIWKLFENSVKDFLKENGFESIVKSEDQNLKFFRRKEIFEVLQEKYGSELETQMVNKDWEIKSIFNGWEKWLWYFDKFFNTRDNFYKTDWTSTAIATRIIKDNLKIFLENTIIFEKVKNKKIDFSEVEKNFSVSIDTFFEINNFNNCFLQDWIDFYNKVIWGETLENWEKLKWLNETINKYRQDTGEKIPYFKKLQKQILSEKDWVFIDKIEDDGGFYEVLKNFYKNAAEKEWFLKNIFENFYTISDKNLEKIYFNKIAFNTISHKFWSALEFERILYEEMKKEKTDWIKFEKKENKYKFPDFIQIIFIKRALENYDSENLFWKERYYKSEENADWFLEKNNNNLWEQFCKILNFEFLNILKRRIIDEAWEEYEVWFEISKNILWEKLENFELNQENKWIIKDFADYSLALYSFWKYFAVEKWRNWDLNIDISDDFYGWEDWYIEKFYNTGYDEIVKPYNLMRNYISKKPWEDNKKWKINFETSSLLSGWDKNLESNWSYIFQKWNKYYLWIINWSKPTNEILEKLYSWDGEKIKRFVCDFQKPDKKNTPRMFIRSKKDSFSPAVEKYNLPINDILEIYDNWLFKTENKDNPNYKESLRKLIDYFKLGFSKHESFKHFNFVWKDSKSYENIADFYRDVEKSCYKIDFEFLNFEELKKLTFEKHLYLFQIYNKDFELDESLQEKWYNFKGEWQKNIHTKYFEALFLEENISRKSWAVFKLSWGWEVFFRKKSIEVEKEKRNSVEVIKNKRYTECKYFLHFPIQVNFKEEISWNFNQEINKFLANNPDINVIWIDRWEKHLAYFSIINQKWEILESWSFNKIENYNKNWEKLLFPEREIKEIHKDWSLIDLELVETWRKVDYVDYKLLLEYKERKRLLQRQSWKEVEQIKDLKKWYISALVRKIADLIIKHNAIVIFEDLNFRFKQIRGWIEKSIYQQLEKALIDKLNFLVNKNEINLEKAGSILKAYQLTVPVDSLKEIWKQTWVIFYTEAAYTSKIDPITGWRPNLYLKKNNSKINKENILKFNNIVFNSKENRFEFTYDLKKFFWKDSKFPAKTVNTVCSCVERFKWNRNLNNNKWGYIHYENLTDWKLANKEQKEDEFSNFKELFEKYFIDINWNILEQIKNLDTKNNEKFFSSFIDLFTLVCQIRNTNQNAKWDENDFILSPVEPFFDSRKSQNFWKSLPKNWDENWAFNIARKGLIILNRISENPEKPDLLIFNADWDNFARNI

SEQ ID NO: 258 - protein, 1226 aa, unidentified
MKNFFQLFTNQYELSKTLRFELRPIENTAELLKKNKIFEKDKKVYEYYQKTKKYFDKLHCEFIDEALVNTSLPNKDYSIYDKLFFEYKKDKENKKIYKALNEHAKKLRTNIVKDFEKTAEKWRDEYILSIKDEKSQKKLKQLEGLDLLFKTEVFDFLKKKYPEAQIEGNSIFDSFNKFFTYFDNFHQSRKNFYKDDGTASAIPTRIIDDNLPKFLENKKIFEEEYKVLNLSREEKDLFRLDFYNKCFTQTGIENYNEIVSKINSKVNKYRQKNKKSKIHFMKELFKQILSKRSKQATEQDTSISIENDSQVFEVLQDFIMETKNCNRMAKNILETFIQHQEEFDLQKVFLKGSNVTRISDMWFTSWFAFGDLLPKNSTGKKLANFISFQDIKNALEKTEIQDVFKKKYAKYNKESFYDQFLQIFDYEFHKALNDCEKNIVEAEKMMKVDKVYSNKKGILRNGKNGEKQKEIIKDFADSALSIYQMMKYFALEKGKKPVTDMDEDPRFYNDYKDWCEKSRTLLYYNEFRNYLTKKPYAEDKIKLNFEKSTLLMGWSANEEGNLQYYSSILRKDNKYYLGLMSSASTFNINKKEAFETRDGFYELMNYRQLKSTTIYGSLYKGEYKKEYRKDKETLTNQELIERTKKILEKQKFSYPQLEVILDKKYKAAEDLAKDLGNIVLYNIGFVKISKRYVNNLTNENFYLFEISNKDFLNKKKKGNVNLHTKYFQLLFDKKNLESKKGAILKLSGGGEVFYRKATKNLPKKKDKKGKEIIDRKRYAEDKILFHLPIVLNIGFKDKQINSKVNQVLATQRKARIIGIDRGEKHLLYISVIDENANILKIKSLNTIDVPNKKEPDDYHKLLDEKEKERDDERKSWHTIENIKELKHGYISQVVNEIDKIIFECLDERILPIIVFEDLNIGFKRGRFKIEKQVYQKFELALAKKLNYLVSKEKGNYLNAFQFTPPVNNFQDIHKKQVGIIFYIPASFTSAICPVCGFRKRLYGFTFKNINQVKKLLAEHEFNIFYDGKRFNFECLASKENEKKENKNGLYTEIFLNKKLFFNSDIERLFNKKSKDNKKWETISFIATEELKKLFEGKIDLKRNIMDQILAGDFRAEFYQQLIFIINRILNLRNCHAVEHRDFIACPSCGFHSEKNYEKLKSRYAGKEKFEFNGDANGAYNIARKGILLIKKIRQFAKSNNIEKLMPYDHLQIDMQEWDKFCAKNKS

SEQ ID NO: 259 - protein, 1334 aa, unidentified
MKTFENFTNLYELNKTLRFELKPIWGTKELIEEKHILKLDKEKRENYEKVRPYFNKIHQEFINFALKNPNFDFLKHKEKYLNWLKDKKNKDLLKEKEKIDKIFLEKIWELFENSVKDFLKENGFESIIKQEDQDLKFFRRKEIFEVLQEKYGSELETQIIWKDWETKSIFSGWDKWLWYFDKFFNTRDNFYKTDGTSTAIATRIIKDNLKIFLENTIIFEKVKNKKIDFSEVEKNFSINIDSFFEINNFNNYFLQDGIDFYNKIIWWETLENWKKLKGLNEIINKYRQDTGDKIPYFKKLQKQILSEKDWVFIEKIEDDGGFYDILKKFYENAVEKEWFLRNIFENFYGIWDENLEKIYFNKVAFNTISHKFWNAQEFEKILYEEMKKSKVDWIKFEKKENKYKFPDFIQIIFIKKALENYDSENLFWKERYYKSEENTDWFLERNNKNLWEQFCKIFKFEFLNILKRKIIDDAWEEHEVWFDISKEILWKKLENFELNQENKWIIKDFADYALVLYSFWKYFAVEKWRNWDPNTEDIDDEFYKWENWYIEKFYDTGYDEIVKPYNLMRNYISKKPWEDSKKWKINFETSSLLSWWDKNLESNWSYIFQKWNKYYIWIINWSKPAKEVLEKLYSWNGEKIKRFIYDFQKPDNKNTPRMFIRSKKDSFSPAVGKYNLPVEDILEIYDNWLFKTENKDNSNYKESLSKLIDYFKLGFSKHESFKHFNFVWKDSKEYENIADFYRDVEKSCYQITSEFLDFEELKKLTFKKHLYLFQIYNKDFELDESLQKNWYNFRDEWQKNIHTKYFEALFLEENILRKSWAVFKLSWGWEVFFRKESIKAEKEKRKNIEVTKNRRYTEEKYFLHFPIQVNFKNEISWNFNQEINKFLANNPDINIIGIDRWEKHLAYFSVINQKWEILESGSFNKIENYDKNGEKILYSEREIKKTYKDWKLIDLELVETWKKVDYVDYKLLLEYKEEKRILQRQSWKEVEQIKDLKKWYISLLVRKIADLIIKYNAIVIFENLNFRFKQIRGWIEKSIYQQLEKALIDKLSFLVNKNEINLEKAGSLLKAYQLTVPVDSLKEIWKQTWVIFYTEAAYTSKIDPITGWRPNLYLKKNNSKINKENILKFDNIIFNSKENRFEFTYDLKKFLWKDAKFPEKTIWTVCSCVERFKWNKFLANNLWDYDHYEDLTDWKLLNRALKEWEFSNFKELFKKYLIDINWNILEQIKNLDTKNNERFFSEFINLFSLICQIRNTNQKEKWDENDFILSPVEPFFDSRKSKKFWKNLPKNGDENWAFNIARKGLIILDRISQNPEKTDLLILNSDWDNFVRNA

SEQ ID NO: 260 - protein, 1217 aa, unidentified
MENNNFKDFTNLYEIPKTLRFELRPREKTKIQLENDWVVKKDKQIEKDYHEIKKFLDLIHIEFVEKSLENIYLENLEEYFETYNYLKLNPKDRNLKNKFEKIEISLRKELVSFFILEGNSWVNKYSFLKKWWIWFLTEKEVLDLLEIKFPDNKNLFERFKWFFTYFQNFNESRKNFYSDDGRTWAIATRAIDENLIIFIENIKKYEEFNIKNPNFFTDKEKEIFKIEFYNFCVNQKWIDKYNEIIWARNLEEWKNTEWINQRINLKKQNDLRNNSKNKNYPKFDLLYKQILSKKDKADFIELIESDSELFNEIEKSKERNYQKIKGAINIFEEFFKNIDNNNIYDLKEIFLSKISINTLSSKYFEKWNSLAWFLEENWNKKLFSLLDVKNALDSQGKGIFSKIYKNIISENKTNFENFINIYNYEFHKKLEEIEENLSKINKINEKNFTRKEKEIQIIKNYFDSVLDFYKMTKYFKVELKKYDDKIDKDISFYTKFDEYIDNFKIWKDYNLVRNFLTKKNIKTDKIKLNFDNSQFLKGWDRDKEKERLGIILRKNWKYFLVVLKKWNNKIFENYKYEWWDFYEKMEYKQLNNVYRQIPRLCFPLQKKINSLKSEEKNKYIEKYIENFWYNEEIAKIKEEFDNFQKNKEKWDRFDIEKIKKLIEYYKNAILKKYGKTYNLSKIEKNNYDNLSEFYDEVEKAMYSLKFVNIWADFIDNLEENGDIYLFQIYNKDFSETKEENSKENIHTKYFKYLFNENNLNNLKIKLSGWAEVFFRDKTENLEQAKDKNWENMFYKLNWENLKVLKHRRYVKDHFQVNISITLNTNSWDMFGFNKFFNNNFDVQHIIWIDRWEKNLAYFSVIDLNWKIKEIWSLNVVNEINYLARLEEKEVKRANERLNWWEIENIKNLKDWYISALVNEICKLIIKYKAVVVFEDLNAKFKTGRQKIEKQVYQKLELALAKKLNFLNFKDKKDTETWWIWNSIQLTPKIIDYQDIANYKQSWIMLYTNPAFTSTTCPECWWRKTVNFPKKINKEVLIKFLENIEILYNPENFIFKYKNWIWNVEEISSIWERTYWNNKDRKTEKINLNYELKKLFLENKINIEENISKQINSKDITLKCLEKLLWIFKLVNSIRNTDSASNKDIIHCPSCWFNSENWFQWFSYNWDANWAYNIARKWIIMLENIKVNSERPNLFVSNSDWDTYLWRKKISLLDIIYE

SEQ ID NO: 261 - protein, 1274 aa, unidentified
MKSDFFAPFTNLYSLSKTLRFELKPIWKTKELLNESNWFFPDFEDKIFPKDKRINEIYQNIIKQCLNNLHSQLIEESLEWVTLELSEDTYKLRKSSIDRKLSENDKKVFNEDFDKKKKELRKQIVNYLTNSRIQEKYSDISGCEDLMKKEIIPVLAKIYSDQIYKVDQNDKTKKYENPDLIWQTYWDLIQNYFIGFFTYLSNFNTNRWNLYKDDGKASRVATRCIEENMIRFFQNKKSYEIFSWFIEITSEAQSCFDILCFQNYLNQKGIQKYNSIIGEINSKINSYNQNHSWWIKLPKLLELHKQILAKPDKENIFSFVSSVIEDDEDLEEQLNNFFVDAESRIAKSVKNILEALFKKNFDYEKIYFKKLILKDISNKYLNNWDALSSLLPQDENGEKQKKWSKTKWKEKRELVSLQEIKSELDSVSLEWFLKESWVKVLKEDFKVSLSSDTPFFQLLKSIRYDACIQKKRVETYTKILDKKLFSGDFSTNLRNKEKDIEVSNVFMTTKTVVKEGIEAVLSFEQILRYFSLEKWQWKTKEIIDVEFDSDFYGEIDEFYANDFRPYKFFNAVRNYVTKKQYSNDKIKLNFDNSTFLDWWDKNKEAANFWVILRKDGKYFLAVMKKWESNIFSESNSELYSSFWKSYEKLNYKQIALPTGVWWFVRKCFKSAQNYWWKCPTSCLNSEWNIIIKDNEVWDNLISLIDCYKDFFNLYEKDGFKYKEFQFKFAESSSYAKLSDFFKDVENQSYKLWFTLINADILDSYVEQWKLFIFQIYNKDFSDYHKWKENLHTKYRRALFSDENLLRNNILFKLLWGAEIFFRPATVSEKRLKDLKKRNDWAIECKRFTEDKILFHCPITLNFVNKNDFKINDKVKEYARNHRMNVMGIDRWEKHLLYYALIDQDGNILKKGDEMQLCTMNTIPSEQPDWTIKEVKYYDKLVKKEGDRAKERTDWNEIENIKEMKTWYLSHVVHKLVDLAISHNAIIVLEDLNSGFKNSRIKVERQIYQKFELALAKKLNFVVDKNKSDDELWWLYQAYQLTPKVENFQDIYTQTWILFYTQAWYTSTTCPVCWFRKNIYKKYDSVRSVKERIKNIDLKIKKEWSDFSFFYTLESLEDRKWNKRAKLDRKLTTKDQIRLYNERIEKWTAYVSTSKNLSEEFGKLFRENNIDQSKIVESMLEIESTQFFKDFIFYWNLLLQIRNSKEWDDGGYLQCPSCWFHSENWFQWTKYNWDANGAYNIARKWVIILKKINDNEKTLWITNVEWDNFSQKYIK

SEQ ID NO: 262 - protein, 1287 aa, unidentified
MKSDFFAPFTNLYPIQKTLRRELKPLNENFEHDPSLSSLRNSDIPQRDEQREKDYQAIKPLLDELHNEFITKSLQSLEPQDRSDFILFYQTYQKSKKNKANLSEKELKSLDEEFESRTKALRAAIGTSFSNTAELRKSNPEYTNEKGKPFLTQKSYKILTEAGVLWLLEKKYASDPESLALIRRFGNFFTYFTGFNQNRENYYATDEKATAVAYRAINENLLTFANNCEVFEKLAVLSLSELEKKVFNPDSYSEYLTQSGIDFYNEMLANIRSKANLYTQEHKTKLPQPKLLYKQIWSPRGNTIPFDLITSEAEFQKMLHTMIRETDQRIPEFKKLLAQIFEEKADLSQIFLSKTALNIISNRYFSSWHTLLEKGVELKLFKFKKNDEESFKLPAYLSLAELKELLEAVPFQAAEKADTAEENHHQISLLKLQRENLHWENSHSNWELLLKSMKSDFESFWTWEGEFWSYTLAKEALQSLSTLESSNQEHKNLIKMLLDNALYAYRMLKWFKVDTSKLGFVPEGDFYPSLDQLLQDYPLPKWYDMIRNYLTRKPYSQAKLKLNFDCSTLLNGRDKNKETQNLSVILRKDGKFYLAIMKKDQNKFFEKSALYEGNLGAMEKMDFKFLPEASKMIPKCSTQLNEVRAAFKKGLPSFIINNEKNFRLPLEVSQRVYNLNNEMYRIENPNKSLISYKKMDKNEKKLYIKSFQKDFLRITWKEDVYKKSLLDWINFCKVFLLSFQSTQNFDFSWLKESSLYGSLEEFYADVDRACYFISWRNVNEELIKQGIKDCSLFLFQISSKDFEGKSKTPDLQTLYRNQIFAPQPNVKLNGEAEIFFRPWSMGKEKKTLKVDNYDVFKHKRYTEDKILFHVPITLWFWNNEVSPSAPSKFNQKLNQELIIPHFDDLHVIGVDRWEKHLAFYSVVSVKTGKIVKQGTLNLLNGTDYEAKLSQKAENRLYARQNRDTIEKIADLKNGYISQVVNKLVELALEYNAVIVFEDLNAGFKRGRQKIEQSVYQKLELALAKKLNFIVKKEKAVGKPWSVTSAYQLAPQINTFWDIKWKQRGIMLYTRANYTSVTDPLTGWRKQHYFKKGSSEEMKAQFFKSFKNLTRDAGQEAYIFDDGTWQLYSNVERRRGKRGDHRERTQIKYDPSLELDTLFSKNQIKKTESLFDQLKNRELPQTFWTSFFRIMDLIMQIRNTDDEGRDIILSPIGNAQERFDSRKRYNQLPCDKNGAVLEESAFEYPTSGDANGAYNIARKGVMMLERIKENPEKPNLLIRDAERDSWVK

SEQ ID NO: 263 - protein, 1276 aa, unidentified
MKNENIFTNFTNLYEIPKTLRFELKMAGWIINEDLFLSDQNFKWKTWTEYYLAKNEVFWKDQIILEAYKRIKPYLDKLHVIFIEESLENLVLDYSEAEKCFLELQNESKKEKKDKIRKELYNIFAKLRKEFTKNFERIWNIWKENYENKTFIDEKWKTRNYKIAWKWYEVLLSDTNLDILIDIFSEETEWENVLIKNIKWEKINIFKSFKGFTTYFSNFNESRKNFYLWDWKSWRIATRIINENLTFFLKNKKNFDEKYKENQIFIEKFNEILNNYGENIEAFFNLNFYNKCYTWKQIEYYNQLIWELNSVINTQKQADYSKYIQWKKDNKNIEFKKSDYPLLKELYKQILSEKDIEKNFIEIENFSDIKTYLKDFYIDNSKRNEIAKNLINNLVNNFDLEFDISKIYVSKISLNTISAKFFWSSKWNFIQKKLLWKIWNKNKNWKLELPDFIDLKIIKDILEETQNENEEDIFKNEFNKIESKNSFEKFLKIFFEELYENIKNSETNWWKVEKNILTLENFSKASEEKEKQIEIIKNYLDSNLNIFRMMKYFALEKGKENLEAKYENNENFYNEFKKFYLDNEIISYYNEFRNFLTKKSYNQDKIKLNFEKWNLLGWWTDSPEWNTQYWAFLFRKWEKFFLWITNFPRILDIEKNPNAYKIEWNNFYEKMTYKQIDSKIIYWSSYLGKYWSKYSDDKEVLSWQELIKRIKELLKEKISFFPELNQFIEKEYSDPKDLANDLKEYSFYSINFNKKVSANFIENGFFEENKILYLFEIYNKDFSAWSKWKQNLHTMYFKWLFEENNLKNIVLKLNGQAEIFRRKASISEPIFDTERNAKVIITEHKRYTEDKLFFHCPIKLNFNRKEKNINDKILELINKNENINIIWIDRWEKHLAYYSVIDQKWNILKDENWKPVKWSFNIIDIFWKNNEKVWEKNYYEKLVEKEGERKEARWSWKTIGNIKELKEWYISQVVHKLAELIIKYNAIIIFEDLNSGFKRWRQKIERQVYQKLEKALIEKLNYLTFKDKNFWEAWHYLSAYQLTQPFETFEKIGKQTWIIFYTDPSYTSQTCPNCWFRKDLYLKYSNLKNAIWDIEKINSITFEKWRFIFEYNKRKVFSDRDRKRNISSIESWVKWWKTVDDNITENLEELFKKYKINFQNWESIITQIQEVNKQELYQKVFENFNAILKIRNSTIWDNSRNWDFICCPSCDFDSRFDTKLWIENWDDNGAFNIARKWIIILDKINKAFEKKKEASKINWEDMIVRQEDWDKFLWNK

SEQ ID NO: 264 - protein, 1350 aa, unidentified
MKTIFDNFTNLYSVSKTLRFELIPVGPDGERLDAEDASKLLVGIREQDRKIKDAYVALKPVMDKIHEEVINNSLSSEEAKKIDFRGYLDKYRQKIEQKINITTEEEELRKLIVKTFTIGTQLVKNKAGNDSKGKPVLKKEGVNCLTEAGILKYIQQIIGELKDEKEKEELEIHLKTFKKFFTYFSGYNQNRENYYAKEEKATAVATRIVNDNLPKFCDNCIQFSDGKLKKKNKNNSDTEEETNTRKDEYLNVHQYLKSANRDTQIKDAKTNKMIETVPIDEKMFDIAGFSKCLTQAGIDEYNRIIGHYNFLINLYNQACKDEEGFKKLFPFKTLFKQIGCGEKRALFHALKYDTRQAQDAKEKTTETLNLEDTLKTISQIGNKYFSKPSQENEQTINGLVEWLKKNKNWDGVYWSKAALDKISDTYFANWHAIKDRLLEGLQSKDKNTKAVYGTVASYNKNREEQLKINDAVELSGLFEILDKENENGWTEDFFKESVLEDRKSLLDTKISPSQNLINLLCADMQDLAKEFCTKSADVLAILDYRNEDNILKIKGWLDTVKSIIWLVKYFDVKESKVKGTLLNSELVNMISELLRADDAKWFEWYDAVRNYLTKKPQDDAKENKLKLNFKNPILLGGWSDGQEKSKGSVLLKNYNKYYVGILSERSLFDTAKKNNPVYNAADKSAGRLILQNLAFKTLAGKGFKRDYKEKYSDVGKRDPQEAIKKLQALIEKQFAVKFSLLKPIVSKEYSAKKEFDKEVKDVLAECYECNFKSINWNLVLKYVADEKLYLFEVYSKDFSENSLGNPNLQTKYWVDAFQNNSTIQLCGGGEIFFRGKAINDIIVHPAQKPIYRRSDGKTESIFLHSIIKDKRFTVEKYSFHIPVKINYQAPDNSLINGKVNLKLHNTVNENVNDYFTQDEDIQFLGIDRGEKHLIYYSLVDAKGKIIEQNHFDVINKKDYLQEINESAKKRRMKQENWQQKGNIKNLKDGYISLVIHEIIQKMKDRNGKFKPTFIVLEDLNTGFKRSRQKFEQQVYQKFELALAKKLNYLVDKNVTMDEIGSVAKALQLTPPVANYQDIENRKQLGIMLYTRANYTSVTDPATGWRKTIYLKKGKDIDTQIFNVFTEIKMDERGDYFFQYTDENTGKIWKLWSGKNGKSLERYRSKRGKNKNEWIVKPFPAKEMLDQLFVNFDKNKSLFDQLKNGKALSKIDDKDTAWESMRFVIDIIQQIRNSGDAAKDQSDNFLLSPVRNEQGEHFDSRKYESLQNSDMPKDADANGAFNIARKGIVMYEHIQQWIKDGKPKFKKTTDLDLFISDKEWDLWTANKKLWKTDLNIFASKQKKEDARNNHQ

SEQ ID NO: 265 - protein, 1364 aa, unidentified
MTFWIMENNNFKDFTNLYEIIKTLRFELKPIEQTKAITEKLWIEEKDELRDKDYDIIKPIFDQLHDKFIRESLFLFNENWSELAKSVNSYKKEIEGINKKVRQTEDDKELLKLQKRKEEEKNNYEKKLDEFRKKITDNYEKIAEKWKNLWKDEKWETILKENWYKILTEAWILKVLKKIFENETEIKNLVKENSKAIEMMENKFIFYLKKIENEKDFSWWVSINTWENEKNFDKNQAKKYLEEILEKIYKKDLKEIQKQVLDVINNLNDFWTYFSAFNNNRENYYSSENKSTAVANRIVNENFITFIWNINNLEKIDISLSNQEDEIFKIENYNKYLSQEGIDEYNEIIWWKKDEKWVRIEDWINQRLNEYSQKNNKEKIQLKPLYKQIWSIKSKSIPFQMVETEEDFKSILEKLINSSKKNIPIIIEKLKNIFENDEKELEKIWISKNNLNFISNRYFSNWYILAEKWVELKVFSKKSKKDLEDGENFSIPKYISLKDFKEMLEKVEFIDYSDIEENKRNYFFKKYFEEKRWKITNNWEFFKKIFREDVENLYSWKDEEIIFAESGNEETFMVKSFLTYLKELEEIIKDFNTKNQKHKKILKLFADKSIFIFQFLRIFKVNRDFIEAKSEFYNFYDEIVEDFLVTKYYDAIRSYLTKKDFSKEKIKLNFNCWYLLNWWDSDFSTYWTLIFKKNDNFYIWIINWTGLSKENVEDLRKWITDENKIKKMVLETQKVDNKNPPRWFIRSKKDTFSPMVREKLIDPKPILEIYDKWLFSKNKNRDSYKQYLPKIIDYFKEWFRKHKDFEDFRDNFLNWSDSNSYETIADFYNETADLCYKLSWEEINFDKIKKLNLEEKIFLYQISSRDFNSNWNKNTQTELFLNLMNEKNNKFLKLLWQWEIFFRKSSSFDKKIIETKKWIKIEKDFENPFHLKRYSSDKIFLHFPITIKWRSLKEWFNSFLNTKIWNPDFYKNIHIIWIDRWEKHLAFYSVINALTWEIVEQWSLNIINWVDYERLLSQRAYSRLKAKQDWESIWNIKNLKEWYISQIVKKISDLVLKYNWIVVMEKLNKWFKRWRQKIEKSIYQNLEVSLVKKLSYLTVKWVEDFENWSIIKAYQLCPLAKNYSDIEKSRQWWILFYANPAYTSVTDPITWWRKNIYLSKWKLEEMKKNILDIFFEIWFDEKEKAYFFKYKILWKEWILYSGRERWRWTVDKKTWKWKIYEIFTTDELDKLFEENEINKNKEIISQIKEKTDLKGKFFESLVWIIDVILQIRNKDDKENDMIISPVKPFFNSKVYFDQLSEDEKNEKFEHTNYLRLPTSWDANWAYNIARKWQIMLEKIQKNPKINQSKLLVNNEQWDEFIQKP

SEQ ID NO: 266 - protein, 1175 aa, unidentified
MNQETIEKMAGLNKKTLTICQKLIPVGKTRENIDKFNSMAEDEFVKANKEKINTLIKKAASEKIDKALETIAQDMDFTKMFELMEKYSDSKEDERDEISEKLFAERINVSTKLTSVFDFKFECKDTIEVLLPEYLNNHDLKDKAELWELVEKIKNRQSMFNKFEGHIDAMLENSHKKGKIVYRLLYENAIILLANVKKIESFDFEKVISGLDEAENIKRDLLDVKPSSYNKYLRQKQIDVYNFCVGAVNNELNLYCQKNKINYSKLELKKLNKMLLSETESFFEKTPVFEKDNDVIDAYNSVICNINKEKFTLDDKKVNANEIIIKGSNIANYSYNVYGDWKIVRDCLQLHCSDMVTASKSKKSEKTLYDEYVKKGISVSMIHNIVTEYAPDLNISCSEVPLTQKIDTIMSGSFRECAYPKVSIKRDDCIEADDIRVTLDRILEARRLLCLYDTENKEFDMEFGELIESYLDILSPAILLYNMCRNYIASKPSPSKKTSLTFNCAAFAQGWSESVEDSKRVSLFKDEKDNKYLAIYNVLGCKENNMPVTRLVSEIYDNMTTEKQDDCYMKFIQNKTGNVSQALPRLFLNPTLSDEDRARFKAKEYNSDKEFLNYIIDVVKNKISEHATWKKYNFNYKDNYESYAEFINDLQEQGYKTEWRYIKKSIIDDYVDRGMIYLFKIYNKDYSEFKTSNKLDIQTQYLNYLFSEENCETGLVKLLANAEVFYRKPQITNPYIHKKGSVLVNKHYTDGRTIGTEYKKIVENPNNFSNIVTKVAKHDIVKDKRYTKEQFELHVPICIDNIRKETRNYNELSKDYITESKNVITITRSRNHLLYVCVFDENRNILEQRSLDIANGINYKAKIQLKEDAKKENIKNWKTIGSNQSIIEGYISGAIKEVTDLVLKYNAIVVLEEDSATADRNLLKIRNYKQFKVALINKLCYLVDTSKDEKEAGGTLNPYNLCKIEKDRDYKKMWNGIVIQVPAYYLSVKDVDSDYIALADVFASTQIQRKNVVKKFNEFRFNKKTHLFELKYESAKFKEDFKTTFICDSSGSRIIRNKNEAFEIDLTEAIKNEMDKADIDYESGDNVYDLLDLDDRKQLAALHNAIRLTLQLYNVGDNNSYFYSPVSHTLIEADRDIFETITCMNAFERAMRLKNKIVEDKPVKFKNLSDIVIGK

SEQ ID NO: 267 - protein, 1164 aa, unidentified
MNNYTDLNKKSITICQKLIPLGKTRENINKFNAMENDEFVKQNKGEVKRLIKAVAREHIDSSLIKVSKTIDFSKMFELMEKAENKETRKEVLGELFAERIELSKIMGKELSSKKFNSAATLTKMVPEYLKNHKSEESNKELIENVKNRQSIFNKYEDTIDFALSPVLKQGTVVYRVLNENAYIFYDNLKRMENFDYFSLVKTEKLENKIITRTDEYKKLMLQSGIENYNYAINIINKNLNEYCQKNKINYSKLKLNELNKMILSETTSFYEEIDDFKTDDEVIMAYNKFADEFNSTNFNELFKTVRDTDKSSLIIKGNLLSAYSINVYGNYKIVPEYVRMHFDETYAQKKNKDSDKEYKKYLDKGLSVENIHFIINTLKKDTEISEYHLMEKIGTLLDTKLDECEKERISLKSDDSYASEIIKNNYDYVIKIKRLLKLFDTESSDFDAKAASSIDSVLEILEPVQKLYNMTRNYISSKPTSKKKMTLTFDTSSFGGGWSESVESSKRVFLMKNDNGDKFFGIYNMVGCKYNNTTVTSIARDIKEQLMDKKPNGEYYRKLVYSSTADVGKMIPKLFINPNLDEDNLKRFKAGEHKTNKEFLDYIIDVVKKAIASHRTWSTYNFKYKDNYESYNDFCDDIQSQGYMTNWKYIDKDYVDSLVESGCIYLFKIYNNDYSKAKKKGGKKKTHTQYLDYLFSDENEKTKLIKLLGGAEVFFREPQIEKPYVHKAGSVLLNKVDKNGNKVTDYKNRLIDAQKVRPNDIYTSVKPYDIIKNKRYTKEQFELHFPISIGSESNPVSFKELTKDMLNTTKSTIVITRSRNHLLYLTVFNEIGDILESKSLNTVNGTDYKERLQLIEKQKKENASNWKTIGSNANLLDGYISYAIKDISDLVLKYEAIVVLESKSISKDKNLLDERAYTKFKTALFKKLEFLIDKTKEDNEPGGLLHPYNLTRVGNRVTSNIIETASNGIVVQVPPYYKAVTDPLIYKNKFVQLAKLYATNNTERKELVSKFHSFFFDGTNFVLEYNTETFKPEISNKFMCSSKGERILYIDKKKTKVNLTEYIKDELNFAGLSYIENENILENADLKDKYIINALYNSIRGILQMYNYSDEEAFFVSPVSILYLDGNDCLEILSCINLLQRSYMIINKVLNDEKPYISFKEMYS

SEQ ID NO: 268 - protein, 1165 aa, unidentified
MIQMTPVSPQMKTITIEARPMWETKKNLQPYVAEESMDMQRIAKYKEVKEVFDTYARKVIEIATQGVADENVLPTYEKLEDLFNQEKNAKTRALYKKACEDYKKLAASIIKKVADDFQLTKNFGKLFKEDSSAIYKNAALLGMKKEDLEVLGLYNNFSSFFTKYFTALSTTMCGVEHGSISFRIMENMERYWQNKQLVRAMEEDPELYMSIKDSIDKMNLEMCMTQDGIDAYNLLLGNTKNTGINSLLNEYAQKKHVRIKLLKPLYKIPLAKVEKQIVVNSIENDDELRVVVLDSLPVAENILDFAKRCLKLTFDDEIKDTTYIYNKNLHTVSYLMFGQFDLLERALKQVELTALEKEQSIISLSHMDAAMKLIEEEPRKSFADIIHDNMAEALKAEKKIPAIRKLCEEQANIKSERAKIKECYDSILFVRRAISMIYTDEVENSFIEDVVGMRDTCAVFNKTYNMVRNYCTKNPIQKKTNDMFFNKGSFLSSFDADKFKEGTSLSTLLRKDGMYYLYILNPAVSTKLSSLAYVEDGGYDRLVYKQISGLSKMFPKCFVSAKDAVERYGLTEEIREIVANKRYTKDANDRESCLKWIQYCMDSFMKNPVWTKYYHVPFKEAEAYESANDFYTRTERHTIYMDWTEHLNEDYVRKSVMDGSAFLFQLYNHDFSPYHTGKDGNYTRILKQLFSEENIHKLNDTDETALKLASGGARLSFRKASIPYKATHRANEELQNKNALNPKKTSKFTYDICKDRRFMSDKFILHIGVQIGFRNEETYTYNLNQIVNEQILKESPNVLTIRTGEEHLLYYMATDAYGHILEQGDLNIIESQGEKFTMRKDFKEILQKREDEMQLAKEAWDYSIDIKDVKNGYVAYAVRAVLDIRDKYDAIIFLEDYSGDFVNKRRANVKAVYQQFQAALLNKLSNYVPTGKTYSETVQLSAPVSSLDDLKGQKGIVFFVNPSYTANVDRTSGFCNQYYDQFTYENMKKADAVCEKLDVQFDEKNREFLISLDDCIEPDKAWQLHTSGERSFWQNKKLAPFNCTEELADLMKDYHMSEFKEYKSVANKAFYERFFTIMRILLKMHYSDSVSGESYFLSPVTGYDTRSKKKGEPLNSSAEKTYLLMLKGIRDLNAINEKTLLIARDEKGKHKENWMKAIRYNLITE

SEQ ID NO: 269 - protein, 1179 aa, unidentified
MDNFKNFTDLKQKQITICQKLIPVGMTRKNIDIFNAMESDEYVSENKGEIRKLIKLLAREKMEEGISKAKPNLSFTKLLGLMSEYNEADSEHKMEVLERLFDERVRLANIIASEFKAKFSCADTITTLLPEYVNEHFNGREREEYLNLLEEVKKHQAMFNKFELNIDNVFSSMLKKGSVVYRMLVENTQIFLNNKLKTDKKDFKKIIDLSELDDETKSIIIKRCIDIDEESYAEVLIQEDIDRYNYCIGMLNSESKMYCDKNKLNYKDFELKNLYKAMLCEKTAFFEKIDSFKNDEQVVDSYNSLMANINEKNIAKTYEKCMGHKDGMHIKPSALSFYSNVVYGKWNVVRNCIRAYCQDEMNSTKKNKKSLDDYYEIFIKKGITINQISNIVSSYAEELELKAFEKDLSNTIYSYLLHKYSCVEEEKTPLKSDESKNAETIRVELEHCIQALRLLKIYDTENDNLNEEMKTLIDEIIDELSPAILLFNMTRNYITAKPTPKKKLALTFNTASFGGGWSESVESSKRVSLLKDDEGNKYLMIYNITGCKANNVSMVSVTEKVKANLLNDKKNIDCYRKLVYSAVPDALKDISRLFINKLEDEEMIKRYKNKEHKENREFLNELINVLKEKINEHPTWSRYGFKFRNEYDSFDDFCSDINNQGYYAKWKYIPKTVIDEYVENGCVYLFRIYNNDYSAYKKAGSKIKTHTRYLDYLFSDENEKTALIRLLGGLEVFYRESQIKNPYVHKKGSILVNKKYKDGTIIGNEYKELFKKAQTTKLDNVYTRVCPYDIIKDKRYTMEQFEVHFPILIGNNNNPESFIEMSKHFVENAKHTVVVGRNRDNLLYVSVYEENALIHSKSLNKVNGTNYKDKLFIIEDAKKNNARNWKTIGSNDALLTGYISAVIKDITDLVLKYNAALVIEMGSNLAKDRNLLPNRVYTKFKEALLHKLEFLIDSEKADDEPGGLLHPYHLAEINKKNPKRSIDTPHNGIVLQVPSFYCGLTDPESNLCNLTYARTKKEKEEVLKKIKGFKYNKEESIFEFVYDMSLFNPNMKGKFTCTSNGNRLVDTENDKVVMDLTHYIEDKLKSLGIEYKSGNEINLISDYGVTNETLFNCIRYTLQMNNGNFFISPVTGFSYTCDGCSNISYNRNLYNRSKLVNENIKSGKKLKLMTIKDIYKPQS

SEQ ID NO: 270 - protein, 1165 aa, unidentified
MLQFADLKKKQITICQKLIPIGKTRENIDTFNAMANDEYVSDNKNEIKKLIKEMARFEIDEKLSNIKGSLDFTNLFTLMNKVDESENKEEILQELFFERAALAKTISSELNFKYTSAKTITEKLPKFISNNYDGDEKEKYLELVDKVKSRQAMFNRFEESIDFIAGELIKKNTLVYRLLVENSQIFLSNYKRIKEQDISSIITNLDVDDSIKTVLQNQCISFTPDNYNELLTQAKIDKYNYCISMINSELNVFCSVNKLSYSSYELKKLYKMILCEKDLLFEKINKFTDDEQVIDTYNDFITNVNDSNLFEKINSSAMDYDNIYIRPNFINAYSNITYGKWNIVSDCIKAHVEDLRLAGKNKITYEKYVENISIVKIDTIVNDYSSELGVKVNGRDYIEIIKEQLLHKYKEVTNDNISLKSDASIVSETIRKELDYALGTIRLLKLFDFENENFNSANEMALNEILDTLNPANLLYNMARNYITQKPSQKSKLNLVFDTNGFAGGWSESVESQKRVTLLKDDEGNKYLGIYNLNGCRANNTSVAAVVKNIQENLDTNSTKYYEKMIYSAVPDAAKDIPRLFINKSENNELIKKFKNKEHKENEEFKNELIEFIKRQIALHPTWSKYEFVYKDNYGSYKDFCNDINKQGYMLNWEKIDKSIIDNYVESGCIYLFRIHNNDYSKYKKTYSKVKAHTQYLDYLFSDENSKTKLIKLLGGAEVFYREPQIKNPYMHKKGSVLVNKKYKNGSPIGNEYKDLVIKAQTTALDNVFTKVSSRYIVKDNRYRKEQFELHFPILIGEERATDYEKICKNYIKNSNHTIVIGRGKNHLLYVSIYENNKVINAFPLDTVNGTNFKAKLEQIEELKNEQRKTWKNISSNRELLNGYVSAAIAPITDMVLKYKATVVIEIGDSSSKSRNLLPNRAYKIFKEALMKKLAFLTDKNKEMDEPGGLLHPYHLVNIDTRNPNRSINAAQNGIVMQVPAFYCALTDPESNLCNLTYAKTLKEKKQVLKKIGEIKYNKDEDIFTFIYDISKFNKDMKGVYECNSNGLRLIYNNNSEEKINLSQYLKNMLQCKSIDYKSGIINYDSEDKESIEAMFLIIRYTLQMLNKTFYISPVTNLTVQSNDCTESMINQNMYNRFLLLKDNLLLNKPTKYLSIKDVYSKLKP

SEQ ID NO: 271 - protein, 1140 aa, unidentified
MNEFLVLEEKTINICRELKPIGKTRSNIDKFKAMEDDDFIYKNKYVINDLLKKVAMEKVEKALKSISKELDFSEMFALMETLDEMQGEERGEVLQNLFAERIALLNELSTVVDFKFTNKKTIEVMLPEYVENHNFKNKDELMKMVEIIKPRQAKFERFEKNIDSLINMNLKKGSLSYRILVENPQIHLENVRLLTRFDYAGILREEPDEVISFCKNSSLDDYNSLLFQKNIDVYNYCVGVINQKLNEYCQQEKLSYSELELKTLRKLPLSERKSFFDKIPFFESDKELVESYNKLVTKLNNHSFNSDVLGNDSNIYIKSNKINNYSNIVYGKWSTINDCLEEYCNEYGEKKEKVLNNISVYDINNMVEEFSEKLEIPYNNNSLQQIIEFSFANTKYAKCDIPMISLRNDECKEKYEIKKNLDKAIEFIRLLRLFDTENENFSFDAKQEIEKTLEIYNDINLLYNMARNYITQKGNNKIKKALSFSTSGFAGGWSESVENTKRVFLMKDDLGSKYLGIYNLIGCKANGKSVSSVSRTIKESLTEEKTEKQCYRKMVYSVTSDVKKSIPRLFVNSQLPEPELTRFKKKEYNDDEKFLTFIIDFIKEKIKKHETWRSYNFKYKEHYESYDEFCDDLQKQGYILKWKYIEKSIIDELVDNGCIYLFKISSKYDRYNFKKSIHEKYIDALFSDENENGKLIRLLGNAEVFYREPQIKNPYIHKKGSILVNKHYDNGKTIGSEYSEIAKNIQGTTVDGIVAKVCDREIIKDERYTKEQFSIHIPVKIGNISSKEKVDSLAIEKLKKPHNTIVITRSNNHFLYAVVFDDKMNVLEKRSLNVVKGVNYKEKLEIAEDLKKKDALSWKEIKSTSGLLDGYISYAIREVADLVLKYDAMVVLEKATVNGGSFNLLSTRTYEKFKNALINKLQFLNDVSKKDTEPGGVLNPYNLTHVGKDKDFEKELNGIVLQIPAFYMAMKDINSEFVLLKSPFAKNQSQRKNLVNKFKNFNFNNEKNVFELEYDSKKFNSKYKNTFICDSFGERIIRQNGETERVNLTDYIKQNLSENGLDFRTGENLYSIYDEQNKSHVNAIYESIKLILQMYNFDSNEAYYVSPVSHTIITDSNCREIVQSINLYKKAVELAKQYYI

SEQ ID NO: 272 - protein, 1232 aa, unidentified
MNYAKFTKQGKLIKGIKLELVPQGNTRDAISEYKIVEADQQLADMVKEVVMAGNEFYKDFIKQIVGHMDGADWQAYGEAVENKATEQKTYDEAVKSISASIKNAILGTAELYGGKKTLFAKDFITIVLRKYVETAENFPYNRERILTCIDVLSDKNVLFKTPYVKWEHIIFGENKGSIAERMLSNFDIFYDNKNKYAALRETATITDFDDFFTDYASYTRYIGQDGIELYNSAISGIYSESGTKISEGINEYINKLKMKHPELHVNMLKKLQKQILSNSEPLFKVATIQSAEELKGIMNKVKVAEESVLSSAKELLVHMETSDLRDLYISGQRLYFVCQKVAKDGGILEELIFNDECSKVEKLTEKKKEEIRDAIVKHDYSFAYIDSLLSEYAEKQVKMVINEELQKLISAIVSSGTSYDSITINPKWKAVPDKEVTIIREYLESFVELNKFLKCLRVRDSDVYPDFKTYATLNVLADELGALNKAYNMVRNFVTKKVNDKDGKTRLCFGRGALLERGWNRKNQSVDWLGNIDHMLLIKDGKYYYAVPAPVKRKTKIYISDTKPSDEVYEYMEISKQSSFLKTFARLFTSLGLKNIGDADDITMDLGNGSMTVTKEFLVKYKDGECKKNTDFMHKSIDIAKEFLTKHYSYATFNFSELKKAKDYNSFYEFANDVDKYTYAVKTKYIDAAIIDKAVEDKELLLFMLSSMDLYKPQEKCKDITALYTRYFFSEENRKKADIWLNANPAIYYRKPLIKFEKTHPAGSILVRKTYEDKDGITHIVPDNVYMSLYNHYNKNTPLNEEAMRYVDLVEHHVAVQDYVKDARYTREMFTINLSFTLNGNAGDAAQAYTINNMVKEEIKAKMPRMLTVVRGYRNLLEYCVTDETGKVFESGNFNTIGEINFKEKLEDLDRARKADAQNWKYEKTVVNIKESYLGMVTSSIVKKAVAYNAIINVEQLSDAFKDKRSCMDNQVFKKFEEKLVSKLACYYDKAKAPTEPGGYLNPLQLASPNCLSNTQNGILFYVSPAYTNEVCPKSNFINLLDFSAAKTLKAKREFLRKMNEICYDAEHEAFHFSFCYDDMPIKLPVKEKKELNDKTNQEFGKHIWTVYTNGVRTEYNKKERKLVELNGTEILGKECAKNNVMLTDHMDVDSMPNSVVNEMIHIFQKYSFGEVAQKDVYYVSPVSPQAEPICTPGELRLRNMSEKGYMILHNIVAGKEKFAVNKMEWLEEKLG

SEQ ID NO: 273 - protein, 1253 aa, unidentified
MELNKFCRLNQSIKTCSLELVPIGRTRETIEKHNVIEEDSKRKENAVLAKEVSDSFIREFIADYKGDFDWSELVACFGKHEEYAGIKEKMEEKIAREFSDAFNGYISKFLKANGVGKADNKTKWSDASYIDVVLPLYASLHPDYDNPKYKEAIASICHCSSTIFKRYITAYEKIINGTKKGSFAERVMDNFQIICTNRLMCEIVFSKIKKADDFRLFLDAPESMNEYLSQKGIDQYNETIGDSFSEKGEILRYGLNHYINEWNQKNPDSRMPKLQKLKKQILSVAEPAFRIDVIDNEKELQETIKNIRAAEVRYSGKLKDILENLNYTNTYIHDGVLVKAAGRENLAKMITGEWNFFREQIREREERRIRDEYLQKKNRIKTKLTKKDEKQIEDTVSKGMYSLVDLNKMLGEEKANIESKLLDEYVKNRSEREKHYTVVANADFMSKESLPTSDEIKIIQNYLDKVIQMTHIIRCLDADAQNEKVDLVFLDDAAELEDDKTLIVTGYNLIRNFLTKKREKTAKEKAVQLCFGRPAHFEQKWNNKQAGKFGNVDAALLEENGKFYYIVPAAKNESKLNFPVTDEPQAGRCYNYLSTQKAIGFAKAFAKFTIKSPEAMSGYAKSEEPFEISVGNQKMTVSKKMYDSYEAKTFRDSEEEKIKLIDYAKEFLQKHGSYNTYDWSELRESKDYVNYGEFCSEVDSIAFRVVNRYISKDLVDDAVLRGDLYMFEITSQDMYKDKNRMKNIMALRFHAIMEGMKTGNKSIIINNAPQIRYRPQIIEAEDKHPAGSKLVNKKTTDGKTIPGDIYLELCDFYNGRKSSLSPEASLYNERVSVKVSDREHIKDKHYTAEKFLITLSYTMNKNVASNTSVYKLNEMIRNEIKENGCNIMSVIRGIDNLLYYAVIDENGNKIEAGDLNVVGDTDFNEMLSVVGTQRYIDQKNWKYEKKVAELKDTYLGQACRKIASIAVKNNAVIVIDKINENTKRKNAAFDNNVYRKFEDALVNTLSNYYDRSIKADEPGGISNPLQLCVNEDNNFQNGILFYTYDAFTKNICMDTGFINLLNTFNVKTVAAKLGFLKKMDGIYYDSDRQEFVFEFAWGKLGSVLKEEEAALYTGLDKSWKVRTHLTRYKRDRESGKYKEVDGTEILKKLIKEKHPDMIGEKINVDKLTSNEVQTVYEIFTLYVNGFIPRMDGESSEYMSPVSDWNSMSNIAYDEMTALQLARKGSLTIGRIKNGFEGKDINISRVDWLNEILR

SEQ ID NO: 274 - protein, 1264 aa, unidentified
MEDRYMDFTKFQKLNSIIKTCSFEMIPIGKTRETMEKHNVIEEDAERKSNAELTKEVSDSFIREFIADYKKDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSGLKETKDYVNYGEFCNEVDSIAFRVINRYVSKKLVDDAVERGNLYMFEISSLDMYKDSSRMKNIMALRFNQIMNGMFTGDKFIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINERTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELSLYNGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 275 - protein, 1234 aa, unidentified
MKKQEFTNREKFTKSLKFEAKPEEATMQAIKEQHLMEANSEMLEKAKELETFIDIVIKEIICKGLAHVTYDMDALCEKYVNASSDRKSYNEELQKLTAAILEKVTAYLPKGMRKINDINSAAFIKDVIPEIITHTNIPDSDKQRCLQLIDEMSSCGTLMDKFLITRTTAVTTWMPKRVIENFEIYMGNMVQVKRFLDEDPSAKDFMVDFPEVSSFACASFYEMCLTPDAISGYNLVISGKYNADGTLAVKGYNQYINELNTAHKHDADYNGCFYRTLKPLYQQILMPKPKLFTIDKLQNDDDLRLLLAETGEKVPKKALFDIVECIKNADKSGIVIDGTCLHTLSHIVYGNHNTIPSAFIEELSNSLEVELHNATKKSEIKALEKAIETVSTTVGSSIYTMSTVEMVLDDDTIFNTYIAYLQERLKNVIACTEALQEENILSKRKIFGRKEAKNVVKNYTQSLLDFRSAVKLIVPNKNNDMQDIIFYERLDKLCEPFAFCVRAYNLCRNYLTAAPRDLAEENIMCFGQSMMLSNTWWKTSFPKLKAGMCAILEKDNKYYYIIKSPLAKPVEILPCEEDNGYHMLSYLKGQDANKLFAKTVFSKEVKSAFLDESIDEVNHPFIAGLTVTREQYAYYLAKTYSLDSVRKGKATEGERLHALATMIDLYKSVIPLYTSTACFDFNLKPTEEYNDIGLFMDDCNRFMTKASWVNVSKDQIDAAINSGSLLSFLITNLNMYKEGKEKTTYAQTFLYMMSEENLKAMNFRLNAKPMMTFRPACLPLDITHPKGSILVNKYDTLGRKIPGNAYVELLNYYNGKLSEKDLAKETLSYIPYSKTRVADFDIAKNFTYMQDKFLISFSYSANADIPDRNRNTISEEVAEEVKKGCKVLSVVRGTSDMLYYVLYDEDRNIIEKRSLNIIGDTDYCSLLRQLTMENRQEQADNWNTPIKVTKIKESYVNFAISEIMQVAVKNNAVIVIEKLDEHFKDKMSLVDNQVYKIFETKLKSRLLDYRNKKIPLGEPGSISTPLQFCKKVIGNPMQNGILFEINGAYTKNMDATTGFIDLFNWNNLNTVSSKRAFLQKFDSITINENKVEYSFDYRNFALRNGIDGDNLKKSDWTVYAGKPCTIYDGFTYKLDNAPAKDVIKKFVVNDLEEASNEVIKMLFDLFKKTLKISSVKQCQENEREYYSSPVAPTDEFAISSAENAARNLANKMFCFQDRIENDSDFTEEWLNYVV

SEQ ID NO: 276 - protein, 1262 aa, unidentified
MKYHKYTKLNSTIKSATFELVPVGKTRDFLELHDVIKEDSERKAKVVLVKEVSDTFIVEFLRNYNNAGICDWENLHKIYNSATCTEIRGCIEKEKEKIAKDLNSALNAYIESFLKYNDINCSDVGWNKKSYVEVALPLYAKSVPDFNTDEYEDALASMKASSSAMFKKCRATYERIINGTNHGSIADRVIENFETFLANKLLYEKILETATGFENDETFTNVSQFGKYLSQNGIDKYNSTIGDFYNSSGELIKRGVNSRITEWNQSNPDNKLPKLQKLKKQILVDREKMFTIETIENKSDFNKTLNTVLILDEKITIETTKLLTSILAKDMYNTEGVYVTRAGGSYIANGLTGSWDYFEAIKTDAITKTVKDKLLTDYFNAKGKVKTNLTKADEKEIEKATKDFSYTIAELDRMLAGTDYITVEEMLIKKLEELKSRKKESYHLMTTCAFWNNDNKPTQDENGVIQKYLDDVLAVVRFTKIFSIDVKLTNADTIFMEDVAGMDKDKHGINKTYNMIRNYLTKKTELDAKQRRVQLCFGRPTHFEQKWNLMHGDKGILGNCDAGLLEKDGCYYYIVPASKNGEKLNIHVSDCEDEADSYNMLSTKKGMGFLKMLIKCTLKSKSAIAKYKETDEPFELPIGDETITISKKMAEDYANKKHSKSKEELIKVIDFAKEFIAKHPSFKRYDLSSLKESSAYDNLKQFSDEVDSLCFAVTRLYVSKEQIDDAVEKGNLYMFMITSQDMYKSADKKHNIYSIRFNAIMKSMFEAGNHIIVNNSPSIYYRPALIEAEDKHPAGSILVNKLTTEGKTIPGEIYLELCAFYNGKCDKLSPLASVYNEKVSVKESTFPHIKDKHYTEEKFSITLSYKMNTNVVGNTSVFTLNNLVQEDIRENGCNIMSVIRGMDNLLYYCIVDSGNKRIASGNLNTIGNADYYEKLCVLGTQRYIDAKNWKYEKKVAELKETYLRQICRKIIKIAIENNAVICIDKVSDLRKNKLSAFDNQVYKKFENTLITALANYYDTSIPNTEAGGSLNPLQLAVEGADTMQNGILFHVAETNTRNICMKTGFINLMSTFGISTVKAKMEYLKKVSRIYYDSKADDFVFEFTWRNLGCCLKKDELPLYNGLDKVWQLHTHLTRLKWNKEKSQYEEIDGTELIKAIRRSHSDMIGKDIEVDMLSSKEIQTLYDVFILYANGFMPKEFMEDTSSYDSPIVPWSSVGRIEYDEMTAYQLCRKASLTMEKIKKGLSSKELVVYRTEWLNYLLEN

SEQ ID NO: 277 - protein, 1258 aa, unidentified
MEFTKYTRSNKIVRSVIFEMSPIGNTRAAIKEHGVIEEDAVRKSNAVLIKEVSDNFIREFLNDDKLEKYDWVEWEDLCLLIDDKPAFDAKAEKMKESIATSISKSFDSYINRFMAANGKANGKYSWKSAGYIDEVIPMYILCHPDYQDEKYTLAAESLKHASSAMFKKYFVSYERILNGTKTGSIAYRVMENVLIFCTNSKMYKKFAAKISGADLFAKIADITVLEDLISQNGIDFYNEMIGDLYDKDGQLIRKGFNSRINEYNSTHPDDKIPYLKKMKKQILSYVEPFFTIDKIESKEDLDNILTSVRATEESLTENLKTLFSNLLSNDKFPLDRILLTSAARSTIANSLAGRWDYFENIIREKETDKLKADYFEKKNRILTKLTKKDQKKINDAVTSNISSIADLNQMLHNVSEETVEDFLIKSLNKQISLKESSYSVLNNSGFMKSDSKPAWDDNQKIQDYLDHVIAISRMLKYFYTDLMNEKVDPIFVEELQMFDDSKDKIVKSYNMIRNYCTTKTELTAKEKRIQLCFGRPVHFEQTWNNKQEGKFGNLDAALLEFDGLYYYIVPAAKNKRKLNFPVTDIPQEGVNYHYLSTKKSIKLSMALPKMTFKSPAAVKKYAETEEPFTINIGNSTMTVSKKMYDDYNLKTFSSSPDARIALIDYAKEFISKEFSFKCYDYSSLKPSEEYRSYGEFCNEVDSITFSTTSKYVNKDLVDNAVMDGDLYMFLITSADMYKDREKNKDITAIRFNTIMQSMFTGDTSIIINNSPTIYYRPQIIEAVDKHPVGSILVNKMTTDGRTIPGEIYLELCDFYNGKKDYLSAEAKAYNENVSVKESSFSHIKDAHYTREMFTISLSYTLNKGVSNEKLGYALNDEIRRDIVEEGCNIMSIIRGINNLLYYCIVDQNGNQLKAGSLNIVGGVDYYEKLTLLSTQRYLDSKNWKYEKKSAELKDTYLGQVCREIAKIAIANNAIIVIDKLIDSIKNKAAAFDNQVYKKFENRLISTLGNYYDVTLPDNEPGGSSNPLQLTVPDNTSIQNGIIFFIIDSGTKNICQETGYVNLLNTYNVNTVTAKAKFLSKISKIYFDADLNEFVFEFSWKDIGSINLKEDEEIPLYLGMNKVWKVRTHITRYKKNKEKRSYEEIDGTEMMKAVMKNYPDMIGKDIDITKLSSKDIQAVYEVFTYYANGFIPRIGNEDSEFISPVSTWTSIGNVPYDEMSAYQLAKKSLLGINKIQFTEDSGRYQYTPVSKVEWYNSLL

SEQ ID NO: 278 - protein, 1262 aa, unidentified
MKYHKYTKLNSTIKSATFELVPVGKTRDFLELHDVIKEDSERKAKVVLVKEVSDTFIVEFLRNYNNAGICDWENLHKIYNSATCTEIRGCIEKEKEKIAKDLNSALNAYIESFLKYNDINCSDVGWNKKSYVEVALPLYAKSVPDFNTDEYEDALASMKASSSAMFKKCRATYERIINGTNHGSIADRVIENFETFLANKLLYEKILETATGFENDETFTNVSQFGKYLSQNGIDKYNSTIGDFYNSSGELIKRGVNSRITEWNQSNPDNKLPKLQKLKKQILVDREKMFTIETIENKSDFNKTLNTVLILDEKITIETTKLLTSILAKDMYNTEGVYVTRAGGSYIANGLTGSWDYFEAIKTDAITKTVKDKLLTDYFNAKGKVKTNLTKADEKEIEKATKDFSYTIAELDRMLAGTDYITVEEMLIKKLEELKSRKKESYHLMTTYAFWNNDNKPTQDENGVIQKYLDDVLAVVRFTKIFSIDVKLTNADTIFMEDVAGMDKDKHGINKTYNMIRNYLTKKTELDAKQRRVQLCFGRPTHFEQKWNLMHGDKGIFGNCDAGLLEKDGCYYYIVPASKNGEKLNIHVSDCEDEADSYNMLSTKKGMGFLKMLIKCTLKSKSAIAKYKETDEPFELPIGDETITISKKMAEDYANKKYSKSKEELIKVIDFAKEFIAKHPSFKRYDLSSLKESSAYDNLKQFSDEVDSLCFAVTRLYVSKEQIDDAVEKGNLYMFMITSQDMYKSADKKHNIYSIRFNAIMKSMFEAGNHIIVNNSPSIYYRPALIEAEDKHPAGSILVNKLTTEGKTIPGEIYLELCAFYNGKCDKLSPLASVYNEKVSVKESTFPHIKDKHYTEEKFSITLSYKMNTNVVGNTSVFTLNNLVQEDIRENGCNIMSVIRGMDNLLYYCIVDSGNKRIASGNLNTIGNADYYEKLCVLGTQRYIDAKNWKYEKKVAELKETYLRQICRKIIKIAIENNAVICIDKVSDLRKNKLSAFDNQVYKTFENTLITALANYYDTSIPNTEAGGSLNPLQLAVEGADTMQNGILFHVAETNTRNICMKTGFINLMSTFGISTVKAKMEYLKKVSRIYYDSKADDFVFEFTWRNLGCCLKKDELPLYNGLDKVWQLHTHLTRLKWNKEKSQYEEIDGTELIKAIRRSHSDMIGKDIEVDMLSSKEIQTLYDVFILYANGFMPKEFMEDTSSYDSPIVPWSSVGRIEYDEMTAYQLCRKASLTMEKIKKGLSSKELVVYRTEWLNYLLEN

SEQ ID NO: 279 - protein, 1278 aa, unidentified
MRILKGNKMKRTKKERLTKVLSFELKPIGKTRQTITDKKLLKTDQEIHERLDTVKPLIDLFYKHYIREALFLMGQPGSDYYIDFTKLEADYRFTSDKELSAEKHRVVVKNYQKDITEIQKIFHAAFLSVCPVKEKDLISAKLFEGIKKYVDTHLVGDPNYMEYQEIMENVTGCAVLLKKFMNTRLTALNTVGKRIMENFECYCNNIANIQLFMKSQVFSELEKNFPDLSSFQYADYYAKILTQEGIDYYNLMISGIFYPDGTRVKGFNMCVNEENIKNRNDHTYTGSFFRTLKKLDKQILYPAEKVFSIEHLDSDEEVRILFRELNGKVPTKKLLDIILLLKETTGDGIFVIGNDVHTLSHLCIKDHNTYPELLEKNYIVQRTNELETVSKQSERKKIEKNIINARSIVGSGNIQYSLEELSVICKSDVKSLYIHELELLYKRVLSKKELFDKSGLIKFGDFHSKVNKKIIKDYLESINDFRHVVQLIARGAESEQADILFYEDLNKQLECFTTAKKALNLVRNYVTRKPADTAKGATTETFFGSAQKTIAKWWNGVDKIDVGKNLILQKDNRYFFATLLPGNSISADSLLKGKSNYSVLTVKKGSNGMKNELPKRMFGQSNGKISVKKMFEADIDYCEWSGTKQDMKYPVKISRELYEANEKGLKTQDAVKKHLCTEEERRYWEVETIRLAQQILPLTVSYANVNWNFKAPEDYSSWLEFCAYCDTKAAYYSWLDVDENQINSLVEDGAMLLFQISHRDLYKNKKNPDSYVKTLEYLLSEENFKNPVIHLNGAPSFQYRKAVYERKITHKKGSILVNRWDKNGEQILNDIYMEIYNYYQGYVSKEELSKEALEELPFVRTKTAWMNFIKSAKYTKEKFLIRIIYTKNADVLNYGYNMINEETKEEIQEAGKAVLSISRSIYDLLYCVLFDKNGKVIEKRSLNIINGIDYYSLLKKIDKYRKSEKSNNWEYTTRIKDIRTHYIDLAIGEIVKYVTTYDAVIVLEKVNNSFKNKMQMIDNQLFKTFESRLELRLNDCYNKNISDGEAGSLTNPYQLTKQGNLSSVQNGYVFYLNGAYTNMCPVSGFVNFFNFGNINALKTKKELLLAMKKISYINNSFQFEFNYNSMERFLKDSWKNTTKEVKKTGYVLKTDWLITAVGPVTRYDREKKKNGYVADRTQKAYDLLKEHNCINDNGNVLVDTLNNTSLNAVYDLFAETVTNTTVRKCDVVPEEYYVSPVAGACLDISPSEIMAENLGRKFFYFMMHDTTEGYIGYMQEQH

SEQ ID NO: 280 - protein, 1162 aa, unidentified
MKESIATSISKSFDSYINRFMAANGKANGKYSWKSAGYIDEVIPMYILCHPDYQDEKYTLAAESLKHASSAMFKKYFVSYERILNGTKTGSIAYRVMENVLIFCTNSKMYKKFAAKISGADLFAKIADITVLEDLISQNGIDFYNEMIGDLYDKDGQLIRKGFNSRINEYNSTHPDDKIPYLKKQILSYVEPFFTIDKIESKEDLDNILTSVRATEESLTENLKTLFSNLLSNDKFPLDRILLTSAARSTIANSLAGRWDYFENIIREKETDKLKADYFEKKNRILTKLTKKDQKKINDAVTSNISSIADLNQMLHNVSEETVEDFLIKSLNKQISLKESSYSVLNNSGFMKSDSKPAWDDNQKIQDYLDHVIAISRMLKYFYTDLMNEKVDPIFVEELQMFDDSKDKIVKSYNMIRNYCTTKTELTAKEKRIQLCFGRPVHFEQTWNNKQEGKFGNLDAALLEFDGLYYYIVPAAKNKRKLNFPVTDIPQEGVNYHYLSTKKSIKLSMALPKMTFKSPAAVKKYAETEEPFTINIGNSTMTVSKKMYDDYNLKTFSSSPDARIALIDYAKEFISKEFSFKCYDYSSLKPSEEYRSYGEFCNEVDSITFSTTSKYVNKDLVDNAVMDGDLYMFLITSADMYKDREKNKDITAIRFNTIMQSMFTGDTSIIINNSPTIYYRPQIIEAVDKHPVGSILVNKMTTDGRTIPGEIYLELCDFYNGKKDYLSAEAKAYNENVSVKESSFSHIKDAHYTREMFTISLSYTLNKGVSNEKLGYALNDEIRRDIVKEGCNVMSIIRGINNLLYYCIVDQNGNQLKAGSLNIVGGVDYYEKLTLLSTQRYIDSKNWKYEKKSAELKDTYLGQVCREIAKIAIANNAIIVIDKLIDSIKNKAAAFDNQVYKKFENRLISTLGNYYDVTLPDNEPGGSSNPLQLTVPDNTSIQNGIIFFIIDSGTKNICQETGYVNLLNTYNVNTVTAKAKFLSKISKIYFDADLNEFVFEFSWKDIGSINLKEDEEIPLYLGMNKVWKVRTHITRYKKNKEKRSYEEIDGTEIMKAVMKNYPDMIGKDIDITKLSSKDIQAVYEVFTYYANGFIPRIGNEDSEFISPVSTWTSIGNVPYDEMSAYQLAKKSLLGINKIQFAEDSGRYQYTPVSKVEWYNSLL

SEQ ID NO: 281 - protein, 1248 aa, unidentified
ALTGVAEYLSIFSEWRTDKKDKTKAKQLSDIEKSLRNEVTRFFEETAKIWAEKYSSIKIKKSGIDFLFEEGIFRVLKERYGNEDDAFVEDDAGNRISIFDQWKGFVGYFTKFYETRKNFYKDDGKASRIATRIVDENLKRFCDNIIAFDRLKQVLDLSEVQGHLKDSLTEVFSPRFYDECLLRQGIDRYNTILGGDSMDQNVKGINQYVNKYLQDHKGERLPFLKPLDKQILSEKESFLEGIESDGELLSVLELFQKNAGKKVGIFRSLMEKFVSKNDAFDLSKIYLSKEGFNTISRKWTDNTRDLESSLHKAMKADKPTGLSYDKTEDLYKFPDHIALSYLQEAISAQNQENTVWKERYYKTEENSSGVLFGNESVWEQFLHILSFEISSLYSTETTHTIAEKEDFATALINAERFEEVFSSDSIVRTIQTKVGYDVFEQKMTSVSGPEFGPDEKVFIKNYADSVLRIYQMAKYFSLEKKGVWNEEYELDSFYSEPEHGYLVFHENVREEIVKVYDALRNYLTKKPYSEEKWKLNFENPTLADGWDKNKESDNSAVILRKDGQYYLGVMKKGKTHIFSERNEKEMGIGGGGMSYEKMVYKLFPDPAKMMPKVCFSAKGLEFFNPPADIMEIYEKGTFKKGENFDIGSMRRLIDFYKECLALYPGWKGYDFSNVKESATYVTNIGEFYSDVAKAGYKVEFVAISESYVGEKNEAGELYLFEIHNKDWNLKDSKRKDGAKNLHTLYFESLFSEENVEADFPMKLNGQAELFYRPATATDKLGFKKNADGTDMVGKNGQKVVNHKRYSEDKILFHVPMTMNRGAGNIYRFNDEINELLAGNPAINIIGVDRGEKHLAYYSVINQKGEVLESGSLNTVNGIDYAGKLDERAKGREQARKDWQAVEGIKDLKKGYVSQVVRKLADLAIEYNAIIVLEDLNMRFKQIRGGIEKSAYQQLEKALIDKLSFLVEKGEKDSESAGHLLRAYQLAAPFESFQEIGKQTGIIFYTQASYTSKIDPATGWRPNLYFKYTSAKKAKEDIERFDAIHFRDGYFEFSYDLGKIVNSEKGATIFPERTDWTVGSCVERYRWNRKLNAGKGGYDYYSDLTEDFRSLFTSVGIGEEGDIKAQIAALDSEGNERFFRDFIFFFSLICQIRNTDPDAKDPDKADFILSPVAPFFDSRTPEAFGTKLPKNGDDNGAYNIARKGIIILDKISDYKRANGSCKNLGWGGLYISHAEWDDFARKNALKNSG

SEQ ID NO: 282 - protein, 1323 aa, unidentified
MTNTKQNSVFQDFTRKYALSKTLRFELRPVGNTREMLDAAGVFEKDRIIKEKYERTKPYFDRLHREFVQESLSDVALTGVAEYLSIFSEWRTDKKDKTKAKQLSDIEKSLRNEVTRFFEETAKIWAEKYSSIKIKKSGIDFLFEEGIFRVLKERYGNEDDAFVEDDAGNRISIFDQWKGFVGYFTKFYETRKNFYKDDGKASRIATRIVDENLKRFCDNIIAFDRLKQVLDLSEVQGHLKDSLTEVFSPRFYDECLLRQGIDRYNTILGGDSMDQNVKGINQYVNKYLQDHKGERLPFLKPLDKQILSEKESFLEGIESDGELLSVLELFQKNAGKKVGIFRSLMEKFVSKNDAFDLSKIYLSKEGFNTISRKWTDNTRDLESSLHKAMKADKPTGLSYDKTEDLYKFPDHIALSYLQEAISAQNQENTVWKERYYKTEENSSGVLFGNESVWEQFLHILSFEISSLYSTETTHTIAEKEDFATALINAERFEEVFSSDSIVRTIQTKVGYDVFEQKMTSVSGPEFGPDEKVFIKNYADSVLRIYQMAKYFSLEKKGVWNEEYELDSFYSEPEHGYLVFHENVREEIVKVYDALRNYLTKKPYSEEKWKLNFENPTLADGWDKNKESDNSAVILRKDGQYYLGVMKKGKTHIFSERNEKEMGIGGGGMSYEKMVYKLFPDPAKMMPKVCFSAKGLEFFNPPADIMEIYEKGTFKKGENFDIGSMRRLIDFYKECLALYPGWKGYDFSNVKESATYVTNIGEFYSDVAKAGYKVEFVAISESYVGEKNEAGELYLFEIHNKDWNLKDSKRKDGAKNLHTLYFESLFSEENVEADFPMKLNGQAELFYRPATATDKLGFKKNADGTDMVGKNGQKVVNHKRYSEDKILFHVPMTMNRGAGNIYRFNDEINELLAGNPAINIIGVDRGEKHLAYYSVINQKGEVLESGSLNTVNGIDYAGKLDERAKGREQARKDWQAVEGIKDLKKGYVSQVVRKLADLAIEYNAIIVLEDLNMRFKQIRGGIEKSAYQQLEKALIDKLSFLVEKGEKDSESAGHLLRAYQLAAPFESFQEIGKQTGIIFYTQASYTSKIDPATGWRPNLYFKYTSAKKAKEDIERFDAIHFRDGYFEFSYDLGKIVNSEKGATIFPERTDWTVGSCVERYRWNRKLNAGKGGYDYYSDLTEDFRSLFTSVGIGEEGDIKAQIAALDSEGNERFFRDFIFFFSLICQIRNTDPDAKDPDKADFILSPVAPFFDSRTPEAFGTKLPKNGDDNGAYNIARKGIIILDKISDYKRANGSCKNLGWGGLYISHAEWDDFARKNALKNSG

SEQ ID NO: 283 - protein, 1405 aa, unidentified
MANIFDSFTNLYSLSKTLRFELRPLPETREFLEMDKLEKEKLFPKDREKADNYQKIKYYLDFLHKEFIQQALSKFKKENINFESYYKNSEESNAEGEEDNSNEVDQENTKEKNLRKKIINNFKESGFLFDKKVIDELGKRFQQRNGQVFLLKNENTGEMEEIKDAPLIVFANTEGKEETIFQNFKGFTGYLKGFHENRKNLYKDDGKAGRVATRIIDQNLPKFLENLENKDNLGEIAGKYEELQKNFNNSWEDYFREKKLNTLEIVKSFAQDGYNWQKVFECNFYNFCLLQKDIEFYNYVVRKLNKDINEYRQKLKAEKKDEDKTAKDGKKEDNKKNKLPFFSELYKQILGEVKKKSDFIEITEENIWKEMKNFIEHSNKKLDLSNRIIQQNFLERTSDFTGIYFSQRAINTISSKWFTGWDFFGGKILDKENEGLVESKKRKKIADFVSFETVKNVLDDLSDVDKGEIFKKEYSHNLEEGQHWNNFLTIWKTEFEELKNEYDSTKIILGGELQNEYCGSKDQKQKVKNFADASLNIFQMTKYFALLKGIKEVNRNDKNTDFYLYMDWYLFGGEDFEGNKYEECNIYEYYNAFRNFLTQKPWSEGKIKLNFENGSPLKCGTRTLIFRNRKGNIFYLGIIRDKVGKIKDFEVSEKNRVFSPDEESFQQMIYKQLKFQTLAGMAYIRDFGKKYSEDKNGIENLKILIKKQFILKYPNLQKIVDTKYENKKIFDADIGKCLLECYSLDFVAIEKGFVFEKVYNKELLLFEISSKDFNKTTSNRNFNTLYFESIFSNGSSSSVIPFKLNNEGAEVFFREATHEHKLGKKKDKKGKEIIDHKRYAENKIFLHLPITLNFGAGDGKYLQLNEKLNQNIFQDADLSKRIKIIGIDRGEKHLAYYSVIDQQGRILDQGTFNRIHEKDRNGKPIIKSEKLIVPIKDENGKTEKYILQDTGNKVSYTDYLPLLECKEKNRLLQRKSWDSIESIKDLKNGFISHVVHQLCELIFKYLEEDGVPPIIVFENLNIGFKQGRQKIERQIYQNLEIDLAKKLNYLIKKEKGESEIGGIIKALQLTPMINNYGSDIEKKSQVGIILYTDPSYTSAICPDCGFRKRVTKTKYESVKKAIKKIQENNIKLVYENGKYAFSFTTRQTKKDSEEEVKMTDMVYSDVSRLFWNGEKKKMDKIENITTKLDEIFQRLKGTHGIEINKDHEITAQILNLDDKKYSGLWSGLMWCFCLILQVRNSENIKFYRDEKSGEIKEEGENRDYIQCPRCYFHSEKDETWNNFKKFFPEEIRKKITERKEDIFNGDANGAYNIARKGILMLRSIKNHPHKIKIFQNLHNINDEELKKKFKNPKNKGKYEIIEGSGRKKKVIDSISKYPELTVYNLDWDTAVQDWDKFITPTPPHA

SEQ ID NO: 284 - protein, 1250 aa, unidentified
MKQFTNLYPVSKTLRFELQPIGKTKENIERAGILQRDEQRAEDYIKVKGFIDEYHKQFIKERLWNFRLPLNSEGSHNSLEEYQKLYELSKRNETQEKEFTELKNNLRRIIVKRLTESGSAFDRIFKKELIREDLVEFLENEEDREIVRQFADFTTYFTGFHENRKNMYTDEEKSTSIAYRLIHQNLPKFMDNMKAFAKIAETSVAEHFADIYDGWKEFLNVGSIEEIFQLDYFSETLTQPHIEVYNYIIGKKILEDGTEIKGINEYVNLYNQQQKDKSQRLPFLVPLYKQILSDREKLSWLAEEFDSDEKMLAAINGSYRHLHDLLMGKENESLLTLLTHLKDFDLTRINITNDLSLTDISQHLFGQYDVFTKGIKEELRLIIPKKREESDEKFEERITKIYKTQKSFSIAVLDKLPQPAMEDNSPRNIEDYFQSLGAINTETNQKENLFAQIENTYEDARTILQTAETGEGLSQNKPAVAKIKALLDALKDLQHFIRPLLGSGEENDKDELFYGTFQLIWDELDTITPLYNKVRNWLTRKPYSTEKIKLNFDNAQLLGGWDVNKEPDCTGVLLRKDGFYYLGIMNKKANHIFDTTITPSDGDCYDKIDYKLLPGANKMLPKVFFSKSRIDEFAPSEAIIRSYKKGTHKKGTDFSLADCHRLIDFFKTSINKHEDWKKFGFHFSDTQTYEDISAFYREVEQQGYMLSSHHVSVSYIHQLVEEGKLYLFRIWNKDFSEYSKGTPNLHTLYWNMLYDNPNLADVVYKLNGQAEVFYRKASIKPENRIIHPAHRSIANKNEFNEKRTSTFEYDIIKDRRYTVDKFQFHVPITINFKATGQSNINPIVQNTIRQGGFSHIIGIDRGERHLLYLSLIDLKGNIVKQMTLNDIINEHNGVTYRTNYHNLLTIREGERTDARRSWDTIETIKELKEGYLSQVIHIISKMMIEYNAIVVLEDLNMGFMRGRQKIERQVYEKFEKMLIDKLNCYIDKQIDPQSIGGLLHPIQLTNKFESFHKLGKQCGCLFYIPAWNTSKIDPLTGFVNLFDTRYDTREKARLFFSKFQRISFNVEKNWFEFSFNYNDFNTKAEGTRTEWTLCTYGERIRTFRNPQKNHQWDDERIVLTDEFKQLFEKYGIDIRRNLKDAICNQNEAQFYRDLLGLMKLLLQMRNSITNSEEDYLLSPVSDETGHFFDSREDIDTLPNNADANGAYNIARKGLWIIRKIQETPDGEKPSLTITNKEWLQFAQTKPYLID

SEQ ID NO: 285 - protein, 1271 aa, unidentified
MNNNLNKFTGLYQLSRTLRFELKPIRKTRDNIERNGFLANDEHRAESYKKVKKLIDRYHKAYIDSVLGRFCLNEDVLANYYDLYMRSSKTEKEAKKFEAIQDYLRKSISAALKKDDRFKRIDKKELIRLDMIVYLTDDEEKALVEEFHDFTTYFTGFHENRQNMYSAEAKSTAIAYRLIHDNLPKFIDNIAVFRQIAETSVADNFLKIYMENEEYLNVNSIEEMFDISYYSMVLTQTQIEVYNSIIGGRTLEDGTKLQGINEYINLYNQNLTDKKKRLPKLKPLFKQILSDRAQLSWLQEEFNTGADVIDAVKEYCKDYYDNIEKSIKALLTSLNDYDISKIYVPNDLQLTDISQRMFGNWSIIPNAIEHDIMYNNPRKANETEEKYAERIAKLKKQQKSFSLAYINDCFRELKDADLSTYFASLGAQNTAEKQTTSITSEIDIYYKQLRPLFNVEYPREKNLSQDKLTVMQLKDLLDAFKTLQRFVKPLLGNGDEAEKDEKFYGELMQLWEIINNLTPLYNKVRNYVTRKPFSTEKIKVNFENAQLLDGWDENKEKDNASIILRKDGVYYLGVMKKEQRKLLAKPMPSSGECYEKVVYKFFKDITTMVPKCTTQTKPVKEHFENSTEDYILFDKKSFDAPVVITKEIYDLNNVLYDGVKKFQIEYLRSTNDKKGYEHAVNTWKAFCIQFLKSYKSTSIYNLSSIEEDIEKYKDLNSFYSAVNLLLYSLTFRKVSVDYIDQLVEEDKMYLFQIYNKDFSQYSKGTPNMHTMYWKMLFDEENLKDVVYKLNGQAEVFFRKKSINVSSPTHPANKPIENKNALNKKKQSTFEYDLIKDRRYSVDKFQFHVPLTLNFKSRGTGNINIDVREYIKESNDIHFIGIDRGERHLLYLCVIDGKGNIVEQYSLNEIVNEYKGNKYSTDYHNLLQERDKKRLEERSSWQTIEGIKELKQGYLSQVVHKISQLVVKYNAIVILEDLNMGFKRGRQKVESSIYQQFEKALIDKLNYLVDKSKAPSEDGGLLRAYQLTSKFDSFQKMGKQSGFLFYIPAWNTSKIDPVTGFVNLFDTRYDNVAKSQAFFNKFDSIRYNEKNDWFEISFDYNNFTAKAEGTKTQWTLCTYGTRIETFRNVDKNSNWDSKEVNLTEKWKSLFDDYSIKYDSNLKDAIILQSSKEFYVRLLHLLKLTLQMRNSITGTEVDYMISPVADANGKFFDSRKSDSSLPENADANGAYNIARKGLWIAQQIREAEDLKKVKLAITNKEWLQFAQTKPYLS

SEQ ID NO: 286 - protein, 1251 aa, unidentified
MKNFNSFTRLYPVSKTLRFELKPIGKTLEHIEQNGLLEQDKHRAESYQKVKELIDDYHKDFINKTLFEFSQKDTLMSKFDGMLEEFFILYQIKNKEDAQKKEFDEKQNKLRKMIVGFIKSDSRFSRIDKKELIKEDLLKFLANDENVALVNEFREFTTYFTGFHENRMNMYSEEAQSTAIAYRLIHENLPKFIDNMQTFLYVAASPVAEKFSEIYRSFEPYLNVSSIEEIFQLNYYKLVLTQTQIDVYNALIGGKTEEDGTKIQGLNEYINLFNQQQTDKHNRLPKFKTLFKQILSDRNRISWLPDAFSSDREVLASIEENYQRLQTTVFQSNEVSHSLKELMISLRDYDLERIWIKNDIQLTEISQKMFGNWNVIEKAIVEALKEEVKRNKKDTDETYLERRLKVYKNIDSFSIEEINHCLEKVGYNQRVEDYFANLGAVDTADKQTESLTAQITNAYTEVKTLLTTPYPEGKNLAQDKENVAKIKTLLDSLKALQHFVKPLLGKGDEAEKDGRFYGDFTALWDELGHITPIYNMARNYLTRKPYSTEKIKLNFENSTLLNGWDLNKETDNSGVLLRKDGMYYLAIMAKGWNKVFTGALPDHGQCYEKIDYKLLPGPNKMLPKVFFSKSRMAEFSPSESLLEHYEQGTHKKGPQFNLSHCHELIDFFKSSIQKHSDWCQFGFQFSDTATYNDLNGFYQEVESQGYKISFRNVSVDYIDTLVDDGKLYLFQIYNKDFSTFSKGTPNMHTLYWKMLFDERNLKDVVYKLNGQAEVFYRKSSIVANAPTHPANKPIANKNPDNAKKESLFYYNLIKDRRYTIDKFMFHVPITMNFKAIGRDNINTQVNDFIRQTDDLHIIGIDRGERHLLYLCVIDMKGNIVEQYSLNDIVNEYNHNRYSTNYHELLERREGERTEARRSWKTIESIKELKEGYLSQVIHKIADLMVKYQAIVVLEDLNLGFKRGRQKVESSVYQQFEKQLIDKLNYLVDKKKAADETGGVLQALQLTNHFESFQKLGKQSGFLFYIPAWNTSKMDPVTGFVNLFDTHYENIEKTRLFFSRFESIRYNTEKGWFEFKFDYSNKFTERAEGTRTLWTLCTQGTRVETFRNPGKNGSWDSVEINLTERFKGFLKEYGIDIHANLKAAIAEQTEKAFYEGLLYLFRLTLQMRNSVTGTEIDYLISPVANETGDFFDSRTCGERLPANADANGAYNIARKGLWAVLQIKASADEKVRLAISNKEWLKFAQEKPYLRD

SEQ ID NO: 287 - protein, 1253 aa, unidentified
MINNFHNFMPKETKEGNIFDTFTGKYQLSKTLRFELKPAEYTKKFLKEHKVFEKDEVIHESYLKAKPYFDQIHREFIEEALAPDNARSLSFISFERVWNVYQKDKKDGRREFETAKKEAYRMVTKLLDDYADSLKGIYAPDAKQSGTELLCSSEILPVLKARFPQEVGEEALFVKDQEGKQRYIFDSFDGFTTYLGKFQETRRNLYKDDGTSTAVATRVIENLVSFLENKSRFEKYLTDAKELHLKDEEVEACKLSNYPNCMIQSGIKVYNGIVGELNTRMKKLRDQAGKDAKKNEYPLLKKFYSQILAKKEIEADEVSIEKIDDVIPAFRNFCREVDRLSDGAQKLMHDIASGTMYSNEHAGIYVHNRAINTIARRRFISAYEFESALXXXXXXXXXNVRVDAFVSLADVENALAEKITEDTLKERIIEEFRLEKKAPAFSQFLMLFAKEMGKLDAGYRAKNKTFSKLNLKIFDRGKKDDHVDKLKDALECGLNIVQFVKYFALSSKKAEDKPASISSEFYNRYDDLYGEPDAKHIIVRYHDAFRNFLTLKLEDADKIKINFESGTPIKWTTRGYIFRDRDTQIYNVGILVKGGGTQSDFEPNKKTKGVYGIESSPFEQMFYQQLKFQTLAGRAYIRDYKLKYSQDPNAVLHLQELIKKQFIKTYPSLQPLISSKYTSKKEFDLAVKECLKGCYALAFMPVVRDYVIKKESEGAIYLFEISYRDKRSKIGALKNIHTLYFEELFSQKNCEHVTLKLNSEGTEIFSRKAQIQEEHEKRRNVEVIKKKRYTTDKIFLHLPIKLNPNAEQVNAGFRYRYNQEINSMALGHGEGNIIGIDRGEKHLAFYSVINRDSKIIASGSFNEINGVNYFEMLRMREKERLEQRRSWKAVSQIKDLKGGYISQVIHQLAELVIEHNAIIVFEDLNLRFKEIRGGVERSVYQQLEKAVIEKFSYMVFKKREALAPGGVLNGYQFATPVQSFEEMSRQNGIIFYVNPEYTSITDPITGWRQHIYLSSSANDSTLLEAFTKKIQIGWDELKQSYTFSYNQKDFARDKDAVSHEWVLYADMPRIDRYRNKDGYWEAHKINPNELLKELFSAWEFHQLEGDMSEQIAIMYADKALQGEREVNGKKQRFFKALRYYLNIIQQIRNSDSVRYVPDRDKEGNIKEDKDNKWVVKKIGDDIDFIASPVEPFFAIPSQYSKENLCGLKIENGDANGAYNIARKGIIALQRVRENPEKPELYITRSDWDRFVQK

SEQ ID NO: 288 - protein, 1249 aa, unidentified
MERLTNLYPVSKTLRFELQPIGKTRENIEKGGILQQDEERAENYKSVKGFIDQYHKQYIKSRLWNFELPLADEGHHNSLTEYRALYELPKRDAEQEAAFTEVKDNLRAIIARRLTEKGSAYDRIFKKELIREDLIEFLEDDKDKDIVRQFADFTTYFTGFHENRANMYSSEEQSTAIAYRLIHQNLPKFMDNMKSFAKIAETSVVEHFADIYAGWEEYLNVGSISDMFRLDYFSQTLTQEHIEVYNYIIGKRILDDGTEIKGINEYVNLYNQQQKDKKQRLPLLVPLYKQILSDREKLSWLSEEFDSDAKMQQAIKETYDHLFDLLMGDENESLKSLLMHLSDFDLSQINITNDLSLTDISQHLFGKYDVFTNGIKDKLKIITPRKKKETDEDFEERITKLFKSQKSFSIAELNSLPHPVVDGDQPKSIEDYYMKLGAVNTETVQKENLFAQIENAYTDVLPILQLTDTDDKLSQNKSAVAKIKKLLDALKDLQHFVKPLLGSGEEVEKDERFYGIFQTIWDELDTVIPLYNKVRNWLTRKPYSTEKIKLNFDNSQLLGGWDVNKEPDCTGVLLRKGNYYYLGIMNKKNNRIFEKDLTPSDGDCYDKIDYKLLPGANKMLPKVFFSKSRIDEFAPSVSLIEKYKAGTHKKGANFNLKDCHNLIDFFKQSIAKHEDWCKFGFHFSDTETYEDISGFYREVEHQGYSLSSHKVSVEYIHQMVDEGKLYLFRIWNKDFSEHSKGTPNLHTLYWKMLFDNRNLQDVVYKLNGQAEVFYRKASIKEENRIIHPAKKNINNKNVLNNKQTSRFDYDIIKDRRFTVDKFQFHVPITINFKATGQTNINPVVHDIIRHGGIKHVIGIDRGERHLLYLSLIDLQGRIVKQMTLNEIINEYAGRQYKTNYHDLLAKREGERTDARRSWDTIENIKELKEGYLSQVVHVITKMMVEYKAIIVLEDLNTGFMRGRQKIERQVYEKFEHMLIDKLNCYIDKQADPATSGGLLHALQLSNKFESFARLGKQSGCLFYIPAWNTSKIDPVTGFVNLLDTHYDTMKATKSFFSKFEHISYNGEKDWFEFTFDYNEFNKKAEGTRTHWTLCTYGTRIRNFRNPQKNNQWDDEEVVLTDMFKKIFDDYGIDYRGNLKEAIQQPTEAKFYQELLSLMKLLLQMRNSKINSEVDYLLSPVADENGYFFDSRQGENTLPDNADANGAYNIARKGLWAIRKIQESPKDEKVSLAISNKEWLTFAQTKPYLE

SEQ ID NO: 289 - protein, 1222 aa, unidentified
LKPSGDSEKQLIETFKRFKTYFTGFHENRKNIYSAEDQSTAVSHRVVHDNFPKFLTNLGVYAALKDKCPSVLYEAEQELAGVLQGFGVNLGDVFAVPFFNRLLTQKGIDFFNTLVGGINAKTNRRVTMLPLYKQILSDRESLSFVPQEFSHNPNEGDKQVWDSVAQFYKVLSGECAADKNGEPVNHFAKLKTLANPDAGYELSGIYIRAKDFAFISSLIFKRWNALKDALKLSLEQKAHPSTGESPSLDLWGEELRLPLKNTRALNPKEKKALKADEFDETKIAEEFSVEELNALLPLIPAAEHEDRKIITAIQKELFEEITKYIDRVECAHSVLFELKDGVNNAALPLREQTLDISRIKSLPDWKDEKRETIPIIELIKLLLDSIQGLFHRLAVFESALPDKDTAFYGDFDAAYNNVRNIIPLYNKVRNYLTRKPSDEGKIKLNFENSTLAAGWDLSKESANSCMIFERDGKYYLGILNKDIEAKERPAFPEKPEDERIADNEACYRKMVYKLLPGPNKMLPKVFFPKNPPVPVPPEILEGYAAGKHKKGDAFDKAFCHKLIDFFKTAIPQYPGWDGFDFHFTPTAQYEDISEFYREVTEQGYKISFVRVPVRFVDGLVETGKLYLFQIYNKDFAAGAKGAPNLHTLYFKHIFSPENRADEVRRTPERGAENIFSPENRADVVIKLSGEAELFYRKASSKNPVRHAPGEKVVNRWYVDENGKNQPLSDKAHKELFEYVNKRRKENELSDEAKPFTERLCEVPPNNRAPSGKIAVKTVTRELVKDRRFTRDTFLFHFPVTLNFKAPASPARFNQKALERLRSLAQEKERKVKIIGIDRGERHLLYVSLIDLRGNIIEQKSLNIVESNAGGEKRRVNYHGKLAVREKERDAARKNWQTIGKIKELKAGYLSLVIHEISKMAVEHNAVVVLEDLNTGFKRGRFKVEKQVYQKFEKMLIDKLNYLAFKDKDPKEPGGVLNAYQLTAPFTSFKELGKQSGWLFYVPAAYTSKIDPATGFANMLDTRYASVDTAQEFFGKFADIRYNATEHYFEFVVDDYSKFNPKAIKSAWTICSYGSRIESLKHDNQRSYRTVSLTEEFKELFDDYTIDYKTNLKQSVVAQPDKNFFVPLLRLLHLTLQLRNSNAETDYIISPVKNASGVFFDSRDYADNENADLPKDADANGAYHIALKGLYLLHYGFPEEKGYLKRISNSEWFRFAEEKPYRN

SEQ ID NO: 290 - protein, 1396 aa, unidentified
MTTETKKFESFEDFTNLYEISKTIQFNLVPLKWDSERKNIAEDKEFAEFKKHGIIEKDEQTSKNIKTTKFYLDILHGEFIEEALKELRFKKEDLEKIYFLSQKLEENKRDKQVNKEEGKKKYGEFKKQLSIARDNLLEELKNIFILTNQRYKLKNKYPSTNENDKNILLSKHVLELLRKRFTKEEIDKLRKNNQDSSIVYPDVEDGKGKSVFNMNAGFLDDFHKNREHSLYSVKGKKGSFGGRILDNFEIFNQNKKIFEEKYKKSDIDFSEVEKSFGRNLNDVFGFDFYNGCISQNGIDCYNKILGGESHKEERKKTRGLNEIINLYAQKKEQDYKEQKKEGNQQKAKFSRKNYPTLMPLQKRVLSKILKKEILIEGDTDLICELNDFIKKSEGKVEKARTMIDLLCSYKKNHFDLTKIYLPKSKINSFAYKVFKEPQEFMAVYRDGRKNLGLIDFGKIKDYLNGNKLEYKDFFKPLAQGESGFDAFLCIWKHEFGILISGGETIVKGGQKEKVINLDIKKSELEKWLKWFKDKVAKNEKMTDKDEGMWCSAVLDYSQTILDITKRAEIFWLNEKQEIKVSDSKDGVFYSWFNEFIDDGFTPFIYFDKFRNYLNKRSKNTAKGFRLYFNTDHLLDGWDMNKEPQYRGFLLRKGNDYYLGIGNENGKIFHKLKSGSNLVEEVPEAYTVKDGDDYYEKIDYKQLDIGKFEGIAFPKKTNSEENYQKALKKRADEFLNGNISKLQKLIETKKEYDDFKVKRQKDKAWDRRFDTKKMKELISYYITCLNTRKEWKRFNFEFKKPEEYNDKPDFVNHLQRQAYWINPKRVSKKYVDEKVAQGEMFLFKIHSKDFYDFEKKLSNNNPYRLDKKPSKTNLFTQYFLELFSDENIRNIKSKDLNKSIFELDGKAELRFRRKTDNVKLKFYKKNGKIITCANKKDGNMEKEVIEHRRFTKDVITLHLKIRLNFGKEIEPQEFNKIVNTKLSVKESIEILGIDRGENNLVYYCLLNEEGEIKECASLNKVGERIRKLGDGTCIKEPVDYYQKLVEREQQRDWEQKNWQKITPIKDLKRGYLANVINEITKIVFANIEKGVATIIALEDLGQNFKRTRFFRERQVYQEFEKDLISKLNYLVDKNKKNYRKAYQFTFKVDSVQDMEKKKQIGNLFYVGASYTSKICPSPTCGWRKRLYIKNSETKGKIVKALESIKIFYEKEKDRFRFDYQWEQKYKKEGKEKKYGDIDTVFSSVSRLRYDRGKNKTEPYKDKTENSVTNKIKDLFKNRINIIQDANITEKIIKKEKELDAGFFHDLINYFNLILQIRNYDKENGDDYIQCPYCGFDSRNSKVDSEQLREIANGDANGAYNIARKGLMLLKRIKANPEKPNLIISSKDWDEVVSEWDK

SEQ ID NO: 291 - protein, 1401 aa, unidentified
MTTETKKFESFEDFTNLYEISKTIQFNLVPLKWDSERKNIAEDKEFAEFKKHGIIEKDEQTSKNIKTTKFYLDILHGEFIEEALKELRFKKEDLEKIYFLSQKLEENKRDKQVNKEEGKKKYGEFKKQLSIARDNLLEELKNIFILTNQRYKLKNKYPSTNENDKNILLSKHVLELLRKRFTKEEIDKLRKNNQDSSIVYPDVEDGKGKSVFNMNAGFLDDFHKNREHSLYSVKGKKGSFGGRILDNFEIFNQNKKIFEEKYKKSDIDFSEVEKSFGRNLNDVFGFDFYNGCISQNGIDCYNKILGGESHKEERKKTRGLNEIINLYAQKKEQDYKEQKKEGNQQKAKFSRKNYPTLMPLQKRVLSKILKKEILIEGDTDLICELNDFIKKSEGKVEKARTMIDLLCSYKKNHFDLTKIYLPKSKINSFAYKVFKEPQEFMAVYRDGRKNLGLIDFGKIKDYLNGNKLEYKDFFKPLAQGESGFDAFLCIWKHEFGILISGGETIVKGGQKEKVINLDIKKSELEKWLKWFKDKVAKNEKMTDKDEGMWCSAVLDYSQTILDITKRAEIFWLNEKQEIKVSDSKDGVFYSWFNEFIDDGFTPFIYFDKFRNYLNKRSKNTAKGFRLYFNTDHLLDGWDMNKEPQYRGFLLRKGNDYYLGIGNENGKIFHKLKSGSNLVEEVPEAYTVKDGDDYYEKIDYKQLDIGKFEGIAFPKKTNSEENYQKALKKRADEFLNGNISKLQKLIETKKEYDDFKVKRQKDKAWDRRFDTKKMKELISYYITCLNTRKEWKRFNFEFKKPEEYNDKPDFVNHLQRQAYWINPKRVSKKYVDEKVAQGEMFLFKIHSKDFYDFEKKLSNNNPYRLDKKPSKTNLFTQYFLELFSDENIRNIKSKDLNKSIFELDGKAELRFRRKTDNVKLKFYKKNGKIITCANKKDGNMEKEVIEHRRFTKDVITLHLKIRLNFGKEIEPQEFNKIVNTKLSVKESIEILGIDRGENNLVYYCLLNEEGEIKECASLNKVGERIRKLGDGTCIKEPVDYYQKLVEREQQRDWEQKNWQKITPIKDLKRGYLANVINEITKIVFANIEKGVATIIALEDLGQNFKRTRFFRERQVYQEFEKDLISKLNYLVDKNKKNYRKAYQFTFKVDSVQDMEKKKQIGNLFYVGASYTSKICPSPTCGWRKRLYIKNSETKGKIVKALESIKIFYEKEKDRFRFDYQWEQKYKKEGKEKKYGDIDTVFSSVSRLRYDRGKNKTEPYKDKTENSVTNKIKDLFKNRINIIQDANITEKIIKKEKELDAGFFHDLINYFNLILQIRNYDKENGDDYIQCPYCGFDSRNSKVDSEQLREIANGDANGAYNIARKGLMLLKRIKANPEKPNLIISSKDWDEVVSEWDKFVQKD

SEQ ID NO: 292 - protein, 1553 aa, unidentified
MEKEKSMFDQFTGKYQLSKTLRFELKPMPRTKRLLGLDNEDIFPKDKERAENYAIIKIYIDKLHSKFINAALALQDAYIDIADFAKEQKSMEGGEEIIDEQFVENNGNEEKRAKSKHHQKIIDLFNQLSKAEKIGGVENRFKGWVNISKNKVSGKLFEKELIDVLKTEFKDEMDTEVPVPVLFFNKDEKGKTRKLKEVFNSFGKDKDGNGQDFTTYFSSAFHDNRRNYYKADGKAGRVATRVVDENLKRFITNLEKFNTIKAEHPELFNERWKEYFVEKGLENENWVKNFEETKWQEDIFGFKYRHFLQSDIDRYNYITRKLNKDINESGSGTKNFQKLHKQVHGEIKKQDEEFKVDKNNIFSSNSSFIKKFIEHSRAKLVFSQKIFSKFFNEEFSDPKNVFLSSRAITTISNKCFASWHTFGGGILDYLNSELPEKKRRKKLPDFVTLQIIKDVLDTAKDTPFQDLFKNKYFEKIDSKDEQRKYEREALEKLRQKLKEGEHWKNFLWIVQFEYKSLVKLHNDTAQKLLAETVYKKGNKDFSKEEQDKQVGILFDFAESANGILNMTKYFALRKRGVMVEDKKYKDRDNIHEQVESYLDGDNEGQERCLINGYYKALKDFVTKKPWIEDKVVLNFDKSQFLGGWAQSQETVKGGVILRKKQDGNDLYYLAALEDRDKTFFKNKDLYENVGESVWQKMVYIQLQEPHRMLPKNLIAPFFVKESKKYQDMNNEKKCEWFNELESKGVKFFLNNDGHNWTKILKEELVRRIKRGIKDKKSIIWAGIDRKKNGAKKLIKQDIKPSDKFLENYLKGKHTKENLDRGYLQEYFGYLKESIKKYYKRDNLSFPDTAEFSDTSPFYTWVKENVYNIKFVDINEQVITDLVINHGNRKQVYLFQIYNKDFELDEEIGKAEYGDKFLTKKEWRKQKERKEEEKEQGRENLETTFFKSLFDSRNLDSDKGVVYKLSGGAKMFYRPASEQLGKKKIKGRDGREKEVVDRQRYKEDKFFLHVPIVMNFVNKNKGYKINDDVNKLIAQTSSGQDKFRVIALDRGEKHLAYLAVLNENGKVLEMQSLNRIQRFDKKNNPIPEKNQYHDKDGKPIGEPQVEPFKDYHNLLDQREIERLKARKSWKPIEKIADLKEGYLGFVVNKIADLVIQAIEKGKVPIVVLENLNAGMKQGRIMIEKQVYSKVEEKIAKKLNYLVDKKLGNFFEAWQLTPEIKTFGGDIEGKSQVGIILYVNPGYTSATCPACGFRRRKYIKTDSAKTEFANIDISFDGAKYKFKDPPNFKDSDVRPIGAAVYSNVRRAIWDRYANNGRGGVQEVADVTKEFSKLFREFGINYRTGNINKQIQNLSFPDKEERKFWTRLCKWFHCVLEIRNSVSKKRAVKEDSANGEVEEWGENRDFIVCPHCYFDSEDGRKWSELEEKIYIGSHPQDLNFNGDANGAYNIGRKGIIAIAKIRGHRENFDRFIKAWNIQCLPKKDEEIPFTKGGKKFTLTTLKDDKKQPYYCFLKTKKESFESIPVERNMRKYPDLFISDNEWDEMTAKWAKENGRK

SEQ ID NO: 293 - protein, 1490 aa, unidentified
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNEIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDNPTFLGGWAYKTTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQIIFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 294 - protein, 1260 aa, unidentified
MKKIDSFTNCYSLSKTLRFKLIPIGATQSNFDLNKMLDEDKKRAENYSKAKSIIDKYHRFFIEKVLSSVTENKAFDSFLEDVRAYAELYYRSNKDDSDKASMKTLESKMRKFIALALQSDEGFKDLFGQNLIKKTLPEFLESDADKEIIAEFDGFSTYFTGFFNNRKNMYSADDQSTAISHRCINDNLPKFLDNVRTFKNSDVANILNNNLKILNEDFDGIYGTSAEDVFNVDYFPFVLSQKGIEAYNSILGGYTNSDGSKIKGLNEYIYLYNQKNGNIHRIPKMKQLFKQILSERESVSFIPEKFDSDDDVLSSINDYYLERDGGKVLSIEKTVEKIEKLFSAVTDYSTDGIFVKNAAELTAVCSGAFGYWGTVQNAWNNEYDALNGYKETEKYIDKRKKAYKSVESFSLADIQKYADVSESSEANAEVTEWLRNEIKEKCNLAVQGYESSKDLISKPYTESKKLFNNDNAVELIKNALDSVKELENVLRLLLGTGKEESKDEYFYGEFLPCYERICEVDSLYDKVRNYMTQKLYKTDKIKINFSNSHFLSGWAQTYSTKGALIVKKENNYYLVIVDKKLSNDDIVFLGTNTQLSPAERIVYDFQKPDNKNTPRLFIRSKGTSYAPAVKEYDLPISDIIEIYDNEYFKTEYRKINPKGYKEALIKLIDYFKLGFSRHESYRCFNFKWKESEQYSDISEFYNDVVKSCYQLKSESINFDSLLKLVDEGKLYLFQLYNKDFSEHSKGTPNLHTLYFKMLFDERNLENVVFKLNGEAEMFYREASISKDDMIVHPKNQPIKNKNEQNSRKQSTFEYDIVKDRRYTVDQFMLHIPITLNFTANGGTNINNEVRKALKDCDKNYVIGIDRGERNLLYICVVDSEGRIIEQYSLNEIINEYNGNTYSTDYHALLDKKEKERLESRKAWKTVENIKELKEGYISQVVHKICELVEKYDAVIVMEDLNFGFKQGRSGKFEKSVYQKFEKMLIDKLNYFADKKKSPEEIGSVLNAYQLTNAFESFEKMGKQNGFIFYVPAYLTSKIDPTTGFADLLHPSSKQSKESMRDFVGRFDSITFNKTENYFEFELDYNKFPRCNTDYRKKWTVCTYGSRIKTFRNPEKNSEWDNKTVELTPAFMALFEKYSIDVNGDIKAQIMSVDKKDFFVELIGLLRLTLQMRNSETGKVDRDYLISPVKNSEGVFYNSDDYKGIENASLPKDADANGAYNIARKGLWIIEQIKACENDAELNKIRLAISNAEWLEYAQKK

SEQ ID NO: 295 - protein, 1217 aa, unidentified
MYENFTNLYKISKTLRFGLIPQGKTLEYIEERGIIEEDTRRAEEKKKVQKLIDGLHKTHIENTLNGFSLGSDLTAYADLYFHPEKGDEAREEMNDLARRMTENISNDLTGAKGYNDLFKADLFDKLLPAMYENDAEAMAAISSFEGFASYFTGYHNNRRLIYDASGKSGSVAGRIIDDNLPIFLDNHRKFTRISEVLPDNIKTAEKELAALLGDDSMSDSFSVEGFSKVMAQSGIDRYNQLIGGFAKEDGTKIKGLNEYINLANQAAESKEDRLPKLTPLKKQILSDRTTLSFIPEAFREDDEVIDALLALDELFRPAAEGMTALISSIGGYDLNGIYIRTKALNDISNKMLGSWSKMKDLLGDKYDFEQDVTEKRRRSAAYRKQKDTALRKKEYYSIGELDIIPGIDGKLSTYITGEAGFCKMSFDLARRDLLAFLQMRGSEPRSLKSSSKAKAVIKEYLDAALNIRRSTENLSVRTGDKDLAFYTDYEPLMDALNAVTSIYNKTRNYLSGKIYTTEKVKLNFGSSLLLDGWAESVESAKLGTLLLKDGKYYLGIIAKGQGNLFKKVPEAVTDDVYMKMRYNLLTGANKALPHVIFSRKGIENYKPSEDIMRIYKSGTFKKGKDFSLEDCHRLIDFYKDCIAVTDAWQMFSFKFSETAAYEDISCFFREVETAGYSLKYRPIDTAVVNELVENGQLYLFEIWHRDFSNKAYGKPDLSTIYWRALFDPRNGEPPICRLNGGAELFFRQASIKPEDAVIHRAGDVVAAKNPLNPKRSKVLKYDIVKDRRFTVNKFQLNVPITINASATNFSFINTEARLAIKKEDNVHVIGVSRGENNLIQLCVLDPKGNVLENRSLNVIEQASGSKPKKTDYAKLLESRELQRMAERKSWESVEGIKQLKDGYIGQVVRILADLMLKYDAVIAIEDMSLGFKQQRQKIEKAVYQQLEARLISKLNLLVNKSAEPDEPGGIYRAYQLTAPFESFDKIGKQTGFIFYVSPWKITEIDSNTGFVNLFDTRYTNIPAAKAFWHAFDRIVYDEEVRAYRFDFDYSYFISENRLKQLDGCRMKWSVFSHGERIRAVRGDKGINYKPINLTESITGLLNDHGIDESSEDLREALCSMTDKSFHEELLALFGLIVQMRTGSNIVSPIMDLATGSFFEAPKDDNSAYNIARKGLMIVNRIKSASEEALTARAGDKTTKPVSLSISSSDWLQHIQEQ

SEQ ID NO: 296 - protein, 1249 aa, unidentified
MKQFTNLYPVSKTLRFELQPIGKTKENIEKNGILLRDEKRAEDYKIVKGFIDDYHKQFIKERLWSFKLPLNSEGHLNSLEEYQALYEVSKRNEVQEAEFSEVKDNLRSIIAKRLTESGSAYERIFKKELIREDLIDFLESKEDKDIVRQFADFTTYFSGFHENRKNMYVAEEKSTAIAYRLIHQNLPKFMDNMKTFAKIAETSVAEHFSDIYEGWKEYLNVGSIEEIFRLDYFSETLTQPHIEVYNYIIGKKILEDGTEIKGINEYVNLYNQQQKDKSKRLPFLIPLYKQILSDREKLSWLVEEFDSDEIMLAAINESYNHLHDLLMGRENESLRSLLLHIKDFDLSQISITNDLSLTDISQHLFSRYDVFTNGIKDELRIITPRKKKESDEDFEDRISKIFKTQKSFSIDFLDKLPQPVMEDGKTRSIEDYFMTLGAVNTGTTQKENLFAQIENAYEDARFVLQLKDTGDTLSQNKSAVAKIKALLDALKDLQHFIKPLLGSGEENEKDDLFYGSFQMMWDELDTITPLYNKVRNWLTRKPFSTEKIKLNFDNSQLLGGWDVNKEPDCTGVLLRKDGLFYLGIMDKKSNHIFETDVIPTDGECFDKIDYKLLPGANKMLPKVFFSKSRIDEFAPSESIITSYKRGTHKKGVGFNLAECHRLIDFFKQSINKHEDWSKFGFHFSDTKTYEDISGFYREVEQQGYMLSSRPVSSSYIDTLVSEGKLYLFRIWNKDFSEFSKGTPNLHTLYWKMLFDERNLSDVVYKLNGQAEVFYRKASIKPENRIVHKANQPVANKNELNTKLASTFEYDIIKDKRYTVDKFQFHVPITINFKAAGQTNINTIVQDAIRQEEFSHIIGIDRGERHLLYLSLIDLKGNIVKQMTLNEIINEYKGQTYKTNYHDLLAKREGDRTNARRSWETIETIKELKEGYLSQVVHIISKMMVEYNAIVVLEDLNTGFMRGRQKIERQVYEKFEKMLIEKLNCYIDKQVSPTAKGGLLNPLQLTCDAQKWKRSHQCGCLFYIPAWNTSKIDPVTGFVNLLDTHYDTREKARVFFSKFQRINYNAQKGWFEFAFDYNDFTSKAEGTRTQWTLCTQGERIRTFRNPQKNHQWDDERIALTDAYKQLFDKYDIDINGNIKEAISAQTDAQFFKELMGLMKLLLQMRNSITNSEEDYLLSPVADDAGHFFDSREGISNLPIDADANGAYNIARKGLWIIRKIQETQSGERISLSITNKEWLQFAQTKPYFND

SEQ ID NO: 297 - protein, 1254 aa, unidentified
MENLNQFVGMYPVQKTIRFELLPVGKTIEWIKKGGIIEEDEQKALDYPIVKKLIDEYHKVCIRESLKREAFGNAPIDWEPLCDALMEYHKTKSEEAKKKLEEEQTIARKKIGKALTAFKHFGELTAATPKDLIKSILPDFQYDKALDSFNSFATYFQGFQENRKNIYSTEAISTGVPYRLVHDNFPKFLTDIEVYETIKENCPQVIEQASDELQPFLEGVMLDDVFSLSFYNSLLTQDGIDFFNLVIGGVSEEGKQKYRGINEFANLYRQQHPDFVGKKKSVTMIPLFKQILSDRETLSFIPQEIKDDDMLVKTIEDFNTHISNYEREGQPINIIAELVNLLKQLPTYDADGIYISQKHMTDVSQKMYGNWGTINERLHEQAVSQFGDETKTKNKKKIDAYLSKDAYSLQEMQIDGKNLLDTYFKEIAQCIYVADGYWRQVQEWANTSTDKQRFLNNQEGTEIVKRYLDSIMDAFHQFSIFDVSGEHEVDANFYNEYIPLYKELESIIPLYNKVRNYLTKKPSDIKKFKLNFEAPTLANGWDQNKERDNKAILLFKDGLSYLGVMNAKNLPDLNVNKHASGECYTKMIYKLLPGPNKMLPKVFFSKKGIDTFAPSAHILKLYNDGTFKKGPSFNLVHLHELIDFYKDGINRHPDWSKFGFEFAPTESYEDISAFYNDISKQAYKVRFTEIPAEQVDEWVNNGQLYLFQLYNKDYAEGAHGKKNLHTLYWESLFTDANMKDLVLKLNGEAELFYRPQSIMKPVAHKVGTKMLNRRDKSGMPIPDAIYRNLYQYFNGKKAENELSDAERMYLDNVIVKDVKHEITKDRRFTKPEFFFHVPITFNVNADGNEFINDQVMEYLKDNPDVNIIGIDRGERHLIYLTLINQRGEILKQKTFNTVNQFNYHEKLTQREKERDEARKSWSSVGKIKDLKEGFLSAVIHEIATMMVENNAIVVLEDLNFGFKRGRFKVERQVYQKFEKMLIDKLNYLCFKDCKSDEPGGILRGYQMAQKFTSFQRLGKQSGFLFYIPAAYTSKIDPVTGFVNHFNLQDITNAEKRKDFFLKMDRIEMRNGHIEFEFDYRQFKTFQTDYQNRWTVSTYGKRIVMSIDKNGYKQMQDFYPTEEIKKAFSQIGVTLQEGADIKALIADIDNPSLFSTLFYAFKVTLQMRNSNSQTEEDYILSPVAKNGSHFCSIEEANKGIDVHGNWVSKLPVDADANGAYHIALKGLYLLQHPDTKKIEHAEWLKYMVEKPYLNN

SEQ ID NO: 298 - protein, 1139 aa, unidentified
ERVVVNKFSKFTTYFDAFYDNRKNLYSGDAKSGTIAYRLIHENLPMFLDNIASFNKISETGVNEYFSSIEAEFTDTLNGKHLADLFQIDYFNNTLTQKKIDNYNYIVGAVNKAVNLYKQQHKNVRIPLLKKIHKMILSDRVTPSWLPERFESDEEMLTAIKAAYESLKEVLVGDDDDSLRNLLLNIDNFDLEHIYIAKDSGLTSISQQIFGYYDTYTLAIKDQLQRKNPATKKQRENPNLYDERIDKLYKKEDSFSIAYLNRLVDTNEHITINEYYRLLGSYCREEGKSKDDFFKQIEGAYSAMSYLFSAEHGEIAQSDSDTAVVQKLLEAYKGLQRFIKPLLGHGDEADKDNEFDVKIRKVWDELDIITPLYDKVRNWLSRKIYNPEKIKLYFENNGKLLSGWSDSQTKSDNGTQYGGYIFRKKNEIGEYDFYLGISADAKLFRRDETICYEDGMYERFDYYHLKPTTLLGKSYIGNYGEDSNAVLSAFNAAITKLQLKKELAPKDNEKVSTYLKRLKQNYANFYQILMNDDNVVDAYKSMKQHLLATLASSIRVPAAIELATQTDLDIEELIDEIMKLPSESFGYFPVATAAIEEAKKREKKPLFLFKMSNKDLSYAEKSSKGQRKSRGTENLHTMYLKALLGMTQNVFPIGSGMVFFRHKTKGLAETTARHKANEFIANKNKLNDKKKSIFGYEIVKNKRFTVDKYLFKLSINLNYSQPNNNKIDVNSKVREIISNGGIKHIIGIDRGERNLLYLSLIDLKGNIVMQKSLNILKDDHNAKETDYKGLLTEREGENKEARRNWKKIANIKDLKRGYLSQVVHIISKMMVEYNAIVVLEDLNPGFIRGRQKIERNVYEQFERMLIDKLNFYVDKHKGANETGGLLHALQLTSEFKNFKKSEHQNGCLFYIPAWNTSKIDPATGFANLFDTRYTTADKALEFFRKFDAIRYNEEKDWFELEFDYDKFTQKAHGTRTKWTLCTYGMRLRSFKNPTKQYNWDYEVAVLTDEFKRILGEADIDIHENLKDAICNLEGKRRKYLEPLMQFMKLLLQLRNSKAGTDEDYILSPVADENGIFYDSRSCGDELPENADANGAYNIARKGLMMIEQIKDAKDLDNLKFDISNKAWLNFAQQKPYKNE

SEQ ID NO: 299 - protein, 1251 aa, unidentified
MKDLKRFIGIYPVSKTLRFELRPVGKTLEWIEKNKVLESDEQKAEDYPKVKTLIDEYHKVCIRESLKDAHFDWMPLRLALEKYQKSKSDEDKAALEKEQAVMRKQVAAAIKEFRHYKELTAPTPKKLIDNVFPGIYESDALKSFNRFSVYFRGFQENRNNIYSAEAISTGVPYRLVHDNFPKFLADIEVFGDIKANCPEVIEQAATELQPILEGVMIDDIFTIDFYNSLLTQDGIDFFNQILGGVAEEGKQKYRGINEFSNLYRQQHPELTAKKKALTMIPLFKQILSDRDTLSYIPQQIESEQQLIDLLNLFYSHITAFDHNGKTVDVLKELTKLTGRINDYNPDGIYLSAKSLTVASQKLFSKWSVITDRLYEQAIKRFGDVSVAKNKKKIDAYLSQDAYALSEIPLDDDHSLSMFFAELPQTIEIISSYWLQFKEWCKGESKQLFLNNADGTEIVKKFLDSIMEILHKCSVLVVSVEHDLDKDFYNDFLPLYAELENVIIVYNRVRNFLTKKPSDTKKFKLNFGVPSLGDGWDQNKERDNKAIILFKDGKSYLGIMNAKDMPMIKERNESTPSSYKKMIYKLLADPAKDFPHTFFSKKGIDTYHPSRYILDGREQGKYKKGETFDKKFMRDFIDFYKDAVAKHPIWSKFNFVFSPTESYEDIGAFFSEVSKQAYKIRFSYVEESQINEWINNGQLYLFQLYNKDYAEGARGRKNLHTLYWESLFSPENLSNIVLKLNGQAELFYRPQSIKQPVTHKMGSKMLNRRDKSGMPIPEAIYRSLYLYFNSKKTESELTLVEKSYLDQVVVKDVTHEIVKDRRYTKPEFFFHVPITFNVNADGNEYINEQVMEYLKDNPDVNIIGIDRGERHLIYLTLINQRGEILKQKTFNMVGNYNYHAKLEQREQERDQARRSWQSIGRIKELKEGFLSAVIHEITMMMIENNAIVVLEDLNFGFKRGRFKVERQVYQKFEKMLIDKLNYLSFKDRKTDDAGGILRGYQLAQQFTSFQRLGKQSGFLFYIPAAYTSKIDPVTGFVNHFNFNDITNAEKRKAFFMKMERIEMRNGDIEFEFDYRKYKTYQTDYQNIWTVNSSGKRIVMRLDENGRKKMTDYYPTQEIVRAFKEKGMLLNEGADIKALLADIDASPMNASLYGVMFYAFQKTLQMRNSNSTTEEDYILSPVAQNGKQFNTDTEANKGRDTNGNWISKLPVDADANGAYHIALKGLYLLMNPQTKKIENEKWLQFMVQKPYND

SEQ ID NO: 300 - protein, 1210 aa, unidentified
GFNVYYQNLTKLYPISKTIRNELIPVGKTLENIRKNNILESDIQRKADYEHAKKLMDNYHKQLINEALQGVHLTSLSEAAGLYLTSSKEMNNADGFGKCQDKLRKEIVGFLKNHENFPKIGSKDIIKLLQQLSNNEDDYNALDSFNNFYTYFSSYNEVRKNLYSDEEKSSTVAYRLINENLPKFLDNIKAYAIAKKAGVRAESLTEEDQDCLFVVDTFERALTQEGIDNYNSSIGKLNSAINLYNQQNKKQEGFRKIPQMKSLFKQILSEREESFIDEFLSDEDLINNIESYAANLSEFFKSEAIANFKNAMVESKGKQVYIKNDVAKTTFSNIVFGSWNVIDEKLLEEYDLANSKKKKDEKYYEKRQKELKKNKSYDLETIIGLFDDNTDVLGKYIEKLELDITAINEAQKVFEEIVLTKHDENKMLCKNTSAVEAIKAYLDTVKDLERDIKLINGSGQEVGKNLVVYAEQENILAEIRNVDSLYNMSRNYLTKKPFSTEKFKLNFNNPTLLAGWDINKEKDYLGVLFEKDGKYYLGIINNEYRKIFEKDNLYTGTINCFNKIVYKQISNAAKYLSSKQINPQNPPREIADILIKRKADSSSLSRTEIEKLIDYLKDDFLINYPMIINKEGENYFNFQFKESKEYASLQEFFADVERQAYSIKTTPIDDSYIYKMIDEGKLYLFQIYNKDFSPYSKGNLNLHTIYLQMLFDQRNLDNIVYKLNGEAEVFYRPASINEDEMITHKAGVEIKNKNSKRAVDKPTSKFDYDIIKDRRYSKDKFMLHIPVTMNFGVDETRRFNDVVNDALRNDEKVRVIGIDRGERNLLYVVVVDTDGTILEQISLNSIINNEYSIETDYHKLLDEKEGDRDRARKNWTTIENIKELKEGYLSQVVNVIAKLVLKYNAIICLEDLNFGFKRGRQKVEKQVYQKFEKMLIDKLNYLVIDKSREQEKAEEFGGALNALQLTSKFTSFKDMGKQTGIIYYVPAYLTSKIDPTTGFANLFYVKYENVEKAKEFFSRFDSISYNNEAGYFEFAFDYKKFTDRACGARSQWTVCTYGKRIIKFRNAEKNNSFDDKTIVLSEEFKKLFSIYGISYEDGAELKNKITSVDEAEFFRGLIRLFQQTLQMRNSSIDGSRDYIISPVLNGRGEFFNSEACDESKPKDADANGAYNIARKGLWVLEQIRKTPSGDKLNLAMSNAEWLEYAQVNQI

SEQ ID NO: 301 - protein, 1252 aa, unidentified
MNNLKQFIGIYPVSKTLRFELRPIGKTQEWIEINKVLEGDVQKAADYPTVKKLIDEYHKICIHDSLKNVHFDWAPLKEAIVIFQKTKSDESKKRLEAEQTIMRKQIAAAIKDFKHFKELTAATPSDLITSVLPEFSDDDSLMSFRGFATYFSGFQENRINIYSQESISTGVPYRIVHDNFPKFLSNQEVYDRIRSVCPEVIKQASEELQPFLEGVMIDDIFSLDFYNSLLTQDGIDFYNRVIGGVSEEGKQKYRGINEFSNLYRQQHKDLAASKKAMTMIPLFKQILSDRETLSYIPVQIESEDELVSSIKQFYEHITHFERDGKTVNVLSELVAVLGNIDSYNPDGICISASKLTDISQKVYGKWSIIEEKLKEKAIMQYGDISVAKNKKKVDAYLSRKAYCLSDLCFDEVVSFSRYYSELPQMLNAINGYWMQFNEWCRSDEKQKFLNNPMGTEVVKCLLDAMMELYHKSAVLVMPEEYEVDKSFYNEFIPLYEELDTLFLLYNKVRNYLTRKPSDVKKFKLNFESPSLASGWDQNKEMKNNAILLFKDGKSYLGVLNAKNKAKIKDAKGDASSSSYKKMIYKLLSDPSKDLPHKLFAKGNLDFYKPSEYILEGRELGKYKKGPNFDKKFLHDFIDFYKAAIAIDPDWSKFNFQYSPTESYEDIGAFFSEIKKQAYKIRFTDITESQVNEWVDNGQLYLFQLYNKDYAEGAHGRKNLHTLYWENLFTDENLSNLVLKLNGQAELFCRPQSIKKPVSHKIGSKMLNRRDKSGMPIPENIYRSLYQFYNGKKKESELTTAEKQYMDQVIVKDVTHEIIKDRRYTRQEYFFHVPLTLNANADGNEYINEQVLNYLKYNPDVNIIGIDRGERHLIYLTLINQRGEIIKQKTFNIVNNYNYQVKLEQREKERDEARKSWDSVGKIKDLKEGFLSAVIHEITKMMIENNAIVVLEDLNFGFKRGRFKVERQVYQKFEKMLIDKLNYLSFKDREVGEEGGILRGYQMAQKFVSFQRLGKQSGFLFYIPAAYTSKIDPVTGFVNHFNFNDITNAEKRKDFLMKMERIEMKNGYIEFTFDYRKFKTYQTDYQNVWTVSTFGKRIVMRIDEKGYKKMVDYEPTNDIIYAFKNKGILLSEGSDLKALIADVEANATNAGFFGTLLYAFQKTLQMRNSNALTEEDFILSPVAKDGHHFCSTDEANKGRDAQGNWVSRLPVDADANGAYHIALKGLYLLRNPETKKIENEKWFQFMVEKPYLE

SEQ ID NO: 302 - protein, 1246 aa, unidentified
MKQFTNLYPVSKTLRFELQPIGKTKENIEKNGILTRDEKRAKDYQVVKGFIDEYHKQYIKDRLWNFKLPLASEGNLDSLEEYQMLYEMPRRDDTHEEDFSEVKDNLRAIITKRLTENGSAYDRIFKKELIREDLIEFLNNEEDKALVRQFADFTTYFSGFHENRRNMYSAEEKSTAIAYRLIHQNLPKFMDNMKAFAKIAETSVAEHFSNIYEGWEEYLNVGSIEEIFRLDYFSETLTQPHIEVYNYIIGKKVLEDGTEIKGINEYVNLYNQQQKDKSKRLPFLVPLYKQILSDREKLSWLAEEFDSDEKMLGAINESYTHLHELLMGEENESLRSLLLHLKEYDLSQINITNDLSLTNISQHLFGRYDVYSNAIKEQLKIIIPRKKKETDEEFEDRISKIFKTQKSFSISFLNNLPHPETENGKPRSVEEYFISIGTINTKTTQKENLFAQIENAYENVRVILQMKDTGNALSQNKPAVTKIKALLDAFKDLQHFIKPLLGSGEELEKDELFYGSFQMIWDELNTVTPLYNKVRNWLTRKPYSTEKIKLNFDNSQLLGGWDVNKEPDCTGILLRKDSFYYLGIMDKKANRVFETDITPSEGDCYEKMVYKQLGQISQQLPRIAFSKTWQQKLSIPEDVIKIKKNESFKKNSGDLQKLISYYKSFISQHDEWNSYFDINFTDRNDYKNLPDFYSEVDSQFYSLSFSRVPSSYINQLVDEGKLYLFRIWNKDFSEYSKGTPNLHTLYWKMLFDERNLSNVVYKLNGQAEVFYRKASIQPENRIIHKANLSIVNKNELNKKRTSTFEYDIIKDRRYTVDKFQFHVPITINFKGTGQLNINPIVQETIRQGGFTHIIGIDRGERHLLYLSLIDLNGNIVKQMTLNDIFNEYKGQTYKTNYHDLLVKREGDRTDARRSWDTIETIKELKEGYLSQVVHVISKMMVEYKAIVVLEDLNTGFMRGRQKIERQVYEKFEKMLIEKLNCYIDKQADATEVTGLLHPLQLTCEAKKWKRSHQCGCLFYIPAWNTSKIDPVTGFVNLLDTRYDTREKARLFFSKFQRISFNTEKGWFEFTFDYNDFTTKAEGTRTQWTLCTHGERIRTFRNPQKNNQWDNERIVLTDEFKKLFDQKEIDISGNMKEAICNQKDAQFYRDLLGLMKLLLQMRNSIANSEEDYLLSPIADKNGHFFDSRERISSLPVDADANGAYNIARKGLWIVRKIRNTSEGEKLSLAITNKEWLLFAQSKPYLND

SEQ ID NO: 303 - protein, 1244 aa, unidentified
MKDLKQFIGIYPVSKTLRFELKPIGKTQEWIEKNHVLEHDWKRTEDYPKVKEMIDAYHKLCIGKSLKNMDFDWVPLRDAIERNRQEKSDGSKKALEAEQTKMRNKIHDQLSKFEHYKKLNADTPSLLINHILPQEDALESFKKFATYFEGFQKNRKNIYSKEAISTGVPYRLVHDNFPKFLANIEVFENLQELCPEVIQQAATEMAPFLQGVMIEDVFTVGFYNTILTQDGIDFYNQILGGVVKDERHYQGINQLTNLYRQAHPDLTANRRSMTMVPLFKQILSDRETLSDISKPIESEEQLIKTVTSFYRRITDFTLNGNCVNIISELAALAQSLNTYNPEGIFISAKSLTDVSHTLYGHWNKLNEKLYEKAVEAIGDIQVAKNRKKVEAYLNKDAYTLSELSFGDDISLAQYFTSISAASGATNSLWVQFQSWCKTAEKPKYVHNEAGTELVKMLLDSIMNVLHKCSALVVSMENDLDKDFYNKFLPLYAELENVILVYNRVRNFLTQKPSSTGKIKLKFDIPSLGAGWGINKEKKNKAILLFKDGRSYLGIMNVKGTLDFDDKAEPGEPTYKKMVCVNHSKPYMDLPNSFFRQTGIDKYKPSERILKIYEAFKKDSKSVDIKEVRGLIDYYKEAITRNEDWNSVSFTYSPTETYETIDDFYKEVAKQSYQVSFKDISQKLVDEWVENGQLYLFQLYNKDYAEGAHGRKNLHTLYWESLFTAENLSDIVIKLGSNAELFYRPQAIKKPVKHEVGTKMLNRRDKSGMPIPDAIYLSLYQFYNGKKEEAELTDEERAYISQVIVKDVQHEIIKDRRYTKQFHYQFHVPIVFNANANGKVKFNDKVMDYIQDNPDVNIIGIDRGERHLIYLTLINQRGEILKQKTFNVVGNYNYQEKLKQREKERKNAQKSWQDIERIKDLKEGFLSAVVHEIAQMMIEYNAIVVLEDLNRGFKRGRFKVERQVYQKFEKMLIDKLNYLSFKDREIANEGGILRGYQLTEMTLNYSDIGRQTGFLFYIPAAYTSKIDPVTGFVNHFNLNDITNAEKRKAFLMKMERMEMKNGNVEFEFDYRKFKTFQTDYQNVWTVNTSGKRIIFDTETRKAKDVYPTKEIVQAFANRGIVLEEGMDLKAIIAEVEPDSKNAAFFRSLFYAFENTLRMRNSNAETQEDYILSPVAISGKQFCTTDEANKGKDANGNWLSKLPVDADANGAYHIALKGLYLLNNPQTKKIENEKWFQFMIEKPYIE

SEQ ID NO: 304 - protein, 1299 aa, unidentified
MKDRNFEHFIGVYPLQKTLRNRLIPVGRTEEFIQERGIISCDEQRARDYNFIKEKIDIFHAELIENVLEKQSNCLDWNGLAEAIAAHKQPKTEDKTALAARVKAEQATMRKAIINLFSMRPDFKLLFKKELISVILPRYFENDQEVQEVLSKFKGFATYFTGFFENRKNVYSVDELPTSIAHRTVHVNFGRYLENISVLRKIEQEYPSALKAAENELKTIFPDFEFKDLFILQNFNKVLSQIGIDRYNGMIGGRTLEGNKKVRGINEHVNLAQHQDKTDGKKQKLKLQLLHKQILSDRTTHSFVYDPLENDYEAFSAICVVSDNLNMSMAEFGNISSLERALELLQHISNYDLNHIFIPAKNLKKLSSQFLGHWSIVGDALDWCVTEEELGPTSGMTKKQAESWRKSGCFSLSDICSALEISGQSLDLGLISMQLGDLKSKANEAYVKVSELAHRFTSGQRRLLQDENATNAIREYLDILLEFLHVLKLFEGSSEEDRDLGFYVDFDQIVHLMSDIVPLYNRVRNYVTQKPYSQEKFKLNFESPTLCDGWDINKESANMATLLRKDDLFYLAIMNPEHRKSFIDAPKATTGEIYQKMIYKFLPGPNKMLPKVFFAASNLDFYNPSDKIMQIYEQGTFKKGNAFSLQDCHMLIDFFKDSIARHPDWSQFGFKFSETSSYKDIAGFYTEVQQQGYKLRFIDIDAFYVDQLVDDGKIYLFQIYNRDFSPHIRNREGASRKNLHTLYLENLFSKENLEDVVLKLNGEAELFYRRGSIENPVVHKTGEKLVNRTYEELDKISGKTIVRRISGKVYLELFKHLNGELAYESLCDEAKELVDKKKVKSRTAAYDIVKDKRYTEDQYFFHVPITINFKAAGSQAFNSKAAASQAFNSKALDYLECNKEVKIIGIDRGERHLLYYTLMDQQGTILEQDSLNSLNGVDYREKLHEREKERDEARKNWKKISKIVDLKEGYLSLVVNKLAKMMVDNNAILVLEDLNFGFKRGRFKVEKQVYQKFEKQLIDKLNYFALKPNDVDVNQAGGVLRGYQLAAPFESFEKLGKQSGFIFYVPAWNTSHIDPTTGFCDLFMRNRELADATNFFSKMESIKYNCDTNYFEFSFDYADYHTRCLSPQTKWTVCSWGDKRWIGTARTTNAGRKYEVDEINVNQELKDIFDNAGISYHDGHDLRSDIAAQETKEFGKKLLKQFKNLLKLRYSTAPSDEEQHDCIISPVMNDTGEFFMSKEGCKNLPENADANGSYNIALKGLQLLREEIEMNEKGLRGIAYPKKPNEAWLRFIQGKEWVE

SEQ ID NO: 305 - protein, 1289 aa, unidentified
MKKESFERFVGVYPMSKTLKNRLIPVGRTEEFIRQRDIISQDEQRARDYEFIKERIDSFHAELIEDVLGDQNNCLDWIGLAEAIAAHKQPKSENKVESAARVTAEQATMRKAIINLFLARPDFKLLFKKELISEILPNYFQDDTEVVEVLSKFKGFTTYFTGFFENRKNVYSADELSTSIAHRIVHVNFGRYLENLSVLRRIEQEYPSALKNAEDELKTIFPDFEFKDLFILQNFNKVLSQIGIDRYNELIGGRTLEGNKKVRGINEHVNLAQQQDKADGKKQKLKLQLLHKQILSDRNTRSFIYDPIENDSEVYSAVRVMSDSLNMPNADFGGASSFERALELLQHISNYDLSHIFVPAKNLEKLSSQFLGQWSVSGDALDRCAVEKLGPASGMTKRQAESWRKSGCFSLSDICSALETSGQTLDLSLAGIRLGDLKAKAEEAYVKVLQLAEECVSGQRKLLEDENATDTLREYLDALLEFLHVLKLFEAPSEEDRDLDFYVDFDYIVAVMGDIVPLYNRVRNYVTQKPYSQEKFKLNFESPTLCAGWDINKESDNVATLLKKDGLFYLAIMNPEHRKSFIDAPEAATEDIYQKMIYKLLPGPNKMLPKVFFCASNIDFYDPSDKIMRIYEQGTFKKGDTFSLKDCHTLIDFFKDSIDRHPDWSQFGFKFSETSSYKDIAGFYTEVQQQGYKLRFVDVDASYVDKLVEEGKVYLFKIYNKDFSLHVRNREKKSSKNMHTLYLESLFSVQNLEDVVFKLNGEAELFYRRGSIKKPVIHKAGEKLVGRTYQEIDKTTGETITRHMPEKVYLELFKNLNGKLAYKSLCDKAKELLDNKKVESRVAEYDIVKDKRYTKDQYFFHVPITINFKATGSQPFNSNALEYLDGNREVKIIGIDRGERHLLYYTLMDQQGNIIDQNSLNSLNGVDYREKLHEREEERKEARKSWKRISKIADLKEGYLSLAVNKLAKMMIDNNAILVLEDLNFGFKQGRVKIEKQVYQKFEKQLIDKLNYFALKPNDVPINQPGGVLKGYQLAAPFESFEKLGKQSGFIFYVPAWNTSHIDPTTGFCDLFLWNRESTDAAGFFSRMETIRYNAESDYFEFSFDYADYHTRCLSPQTKWTVCSHGDRRWIWTARTTKTGRDYEVDEINVNQELKDIFDSAGINYHDGHDLRGDIAAQETKEFGKKMLRQFKNLLKLRYSTAQSDEEQHDCIISPVMNDNGEFFMSKEGCKNLPENADANGAYNIALKGLQLLREQIEVNEKTGLRRIAYPKKPNEAWLRFVQGKEWME

SEQ ID NO: 306 - protein, 1215 aa, unidentified
MDYFQAKQILENDEKLKEDYQKIKEIADRFYRNLNEDVLSKTGLDKLKDYADIYYHCNTDADRKRLNECASELRKEIVKNFKNRDEYNKLFNKKMIEIVLPKHLKNEDEKEVVASFKNFTTYFTGFFTNRKNMYSDGEESTAIAYRCINENLPKHLDNVKVFEKAISKLSKNAIDDLGATYSGLCGTNLYDVFTVDYFNFLLPQSGITEYNKIIGGYTTSDGTKVKGINEYINLYNQQVSKRDKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFSENYDNEKGLKNDDKSISLIKNFLDAIKEIEKFIKPLSETNITGEKNDLFYSQFTPLLDNISRIDILYDKVRNYVTQKPFSTDKIKLNFGNSQLLNGWDKDKEREYGAVLLCKDEKYYLAIIDKSNNSILENIDFQDCNESDYYEKIVYKLLTKINGNLPRVFFSEKRKKLLSPSDEILKIYKSGTFKKGDKFSLDDCHKLIDFYKESFKKYPNWLIYNFKFKNTNEYNDISEFYNDVASQGYNISKMKIPTTFIDKLVDEGKIYLFQLYNKDFSPHSKGTPNLHTLYFKMLFDERNLEDVVYKLNGEAEMFYRPASIKYDKPTHPKNTPIKNKNTLNDKKASTFPYDLIKDKRYTKWQFSLHFPITMNFKAPDKAMINDDVRNLLKSCNNNFIIGIDRGERNLLYVSVIDSNGAIIYQHSLNIIGNKFKGKTYETNYREKLATREKDRTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKADNVSTVEPVIHNDKWLKFVQENDMANN

SEQ ID NO: 307 - protein, 1215 aa, unidentified
MDYFQAKQILENDEKLKEDYQKIKEIADRFYRNLNEDVLSKTGLDKLKDYAEIYYHCNTDADRKRLNKCASELRKEIVKNFKNRDEYNKLFDKRMIEIVLPKHLKNEDEKEVVASFKNFTTYFTGFFTNRKNMYSDGEESTAIAYRCINENLPKHLDNVKAFEKAISKLSKNAIDDLDATYSGLCGTNLYDVFTVDYFNFLLPQSGITEYNKIIGGYTTSDGTKVKGINEYINLYNQQVSKRDKIPNLQILYKQILSESEKVSFIPPKFEDDNELLSAVSEFYANDETFDEMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENNEIREKSIVDYYKTSLMQLTDNLSDKYNEVAPLLNENYSNEKGLKNDDKSISLIKNFLDAIKEIEKFIKPLSETNITGEKNDLFYSQFTPLLDNISRIDILYDKVRNYVTQKPFSTDKIKLNFGNYQLLNGWDKDKEREYGAVLLCRDEKYYLAIIDKSNNRILENIDFQDCDESDCYEKIIYKLLPTPNKMLPKVFFAKKHKKLLSPSDEILKIRKNGTFKKGDKFSLDDCHKLIDFYKESFKKYPNWLIYNFKFKKTNEYNDIREFYNDVALQGYNISKMKIPTSFIDKLVDEGKIYLFQLYNKDFSPHSKGTPNLHTLYFKMLFDERNLEDVVYKLNGEAKMFYRPASIKYDKPTHPKNTPIKNKNTLNDKKASTFPYDLIKDKRYTKWQFSLHFSITMNFKAPDKAMINDDVRNLLKSCNNNFIIGIDRGERNLLYVSVIDSNGAIIYQHSLNIIGNKFKGKTYETNYREKLATREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGTQSGFIFYVRPDFTSKIDPVTGFVNLLYPRYENIDKAKDMISRFDDIRYNAGEDFFEFDIDYDKFPKTASDYRKKWTICTNGERIEAFRNPANNNEWSYRTIILAEKFKELFDNNSINYRDSDDLKAEILSQTKGKFFEDFFKLLRLTLQMRNSNPETGEDRILSPVKDKNGNFYDSSKYDEKSKLPCDADANGAYNIARKGLWIVEQFKKSDNVSTVEPVIHNDKWLKFVQENDMANN

SEQ ID NO: 308 - protein, 1215 aa, unidentified
MDYFQAKQILENDEKLKEDYQKIKEIADRFYRNLNEDVLSKTGLDKLKDYAEIYYHCNTDADRKRLDECASELRKEIVKNFKNRDEYNKLFNKKMIEIVLPQHLKNEDEKEVVASFKNFTTYFTGFFTNRKNMYSDGEESTAIAYRCINENLPKHLDNVKAFEKAISKLSKNAVDDLDTTYSGLCGTNLYDVFTVDYFNFLLPQSGITEYNKIIGGYTTSDGTKVKGINEYINLYNQQVSKRYKIPNLKILYKQILSESEKVSFIPPKFEDDNELLSAVSEFYANDETFDGMPLKKAIDETKLLFGNLDNSSLNGIYIQNDRSVTNLSNSMFGSWSVIEDLWNKNYDSVNSNSRIKDIQKREDKRKKAYKAEKKLSLSFLQVLISNSENDEIREKSIVDYYKTSLMQLTDNLSDKYKEAAPLFNESYANEKGLKNDDKSISLIKNFLDAIKEIEKFIKPLSETNITGEKNDLFYSQFTPLLDNISRIDILYDKVRNYVTQKPFSTDKIKLNFGNSQLLNGWDRNKEKDCGAVWLCKDEKYYLAIIDKSNNSILENIDFQDCDESDCYEKIIYKLLPGPNKMLPKVFFSEKCKKLLSPSDEILKIRKNGTFKKGDKFSLDDCHKLIDFYKESFKKYPNWLIYNFKFKKTNEYNDISEFYNDVASQGYNISKMKIPTSFIDKLVDEGKIYLFQLYNKDFSPHSKGTPNLHTLYFKMLFDERNLEDVVYKLNGEAEMFYRPASIKYDKPTHPKNTPIKNKNTLNDKRASTFPYDLIKDKRYTKWQFSLHFPITMNFKAPDRAMINDDVRNLLKSCNNNFIIGIDRGERNLLYVSIIDSNGAIIYQHSLNIIGNKFKGKTYETNYREKLETREKERTEQRRNWKAIESIKELKEGYISQAVHVICQLVVKYDAIIVMEKLTDGFKRGRTKFEKQVYQKFEKMLIDKLNYYVDKKLDPDEEGGLLHAYQLTNKLESFDKLGMQSGFIFYVRPDFTSKIDPVTGFVNLLYPRYENIDKAKDMISRFDDIRYNAGEDFFEFDIDYDKFPKTASDYRKKWTICTNGERIEAFRNPASNNEWSYRTIILAEKFKELFDNNSINYRDSDNLKAEILSQTKGKFFEDFFKLLRLTLQMRNSNPETGEDRILSPVKDKNGNFYDSSKYDEKSNLPCDADANGAYNIARKGLWIVEQFKKSDNVSTVEPVIHNDKWLKFVQENDMANN

SEQ ID NO: 309 - protein, 1291 aa, unidentified
MENKNCNFDKFTKQYQVSKTVRFALTPIGRTEEHIIEKQYIEAAQRKDQAYKIVKPVIDKKLCVMIDDVLTHCEKQDWEKLNELTLQYQNDKTSVEALGEQQGKIRKNISKEFENSIEYKNFFGKDSEKLFKTFLPQCLEEINASEADKEAVKEFQKFKTYFNNFLTVRKDIFNDDSKQNTIPYRIVNENFMIFAGNRKTFSNIVKLIPDASAEIAKEGIERQEWEFYDVQNIDSCFEPDSFQQCMSQLGIQKYNFIVGLVNSYMNLYIQQHPEALEVKRSRLKLRMLHKQILSDRTNPSWLPEQFAEGEEGEKQIYEAIQALEDDLNKNHFQEKFDNLLQLIDTENPRIYIAASEMPRVSSALNYGWNGLNNVRKNVLQELNSEAKIEKILKQDVSLNELSDALNKYADIYKKEQVPTLQQYIEYGKELLQDCAVACNDYHASIRNNVERLNQNEKLIEVLKTYLDCYQRVMHFMNVFVVGDELDKDVDFYAELDELIEDISQIIPLYNKVRNYVTRKAYSLDKIRIMFEKSDFLGGWGQDFDTKKALIFEKDGLYYIGIIEKKYTNTDVQYLYEEIEEGNKAVHFVYNFQKIDNKNFPRIFIYSKGTNYAPAVRKYNLPIQNIIDIYNERKFQTDYKKVNEQEYYESLEKMIDYFKDGIMKNETYRKFHFNWKPSNEYENIKEFYDDTDNSCFLLEKEEINFNHLKEQADQGKIYLFQISSKDFNKGSTGTPNLQTMYWRELFSDQNCKEGIIKLCGGASIYMRDVSIKQPIIHKKDSWLINKWYMEEGQNKVIPDDTYVKFSQIVQGRMSEAELNVEEQQLWNSGLIQKKKATHDITKDRRFTRKQYMLHAPLIINYKQQDIPTPRRFNEEVRSFLKNNPNINIIGIDRGEKNLIYITVIDQKGNILSGMQKSFNQIEEKGANSRIVDYYGKLQSVEDRHTEARKNWKQIGTIRELKEGYLSQVVHEIAQLMIQYNAIIVMENLNMGFKKGRMKVEKNIYQRFEKMLIDKMNYLAFKKNIEGKAINPYEIGGVMNGYQLTNKFTNFADMGSQNGFIFYVPAAYTSVIDPVTGFVDVFQRAEFKTGDFLQKFEDISWDDKEQSFVFTFDYQKFKCNGTCYQNKWSLYADVNRIETVKKNNQVYRQEQCNPNQRLIELFDSKGIAYRDGHNLVNDLENYDSKLLSDILYNFRLILQLRNSMRDYSTGEVIDYIASPVMYHRERFNSQKKNPSLPLDADANGAYHIALKGLMCLQKINEYADPDGKMDIKNMKITNEEWFKFMQTRRESNV

SEQ ID NO: 310 - protein, 1291 aa, unidentified
MGYENFINKNSCVKTLVNELRPTEWTRKHIEEDAILSADELRAEESDKLKSIMDDYYRRYIYTKLSGVSSLDWDELFSIMEVAYKSGKKDKNCKAQLEKVQEEMRGKFYNVLSDDDIFKMMFSGKFVTKVLPEFVRNNKEYSAEEKQQKLDTLKLFKGFTTSLVPFFNNRENIFSKKPIHSSICHRTVDENTAIFYQNIISYKNIEDNAPQEIEKIEHQGRQQLDEWKLPDIYSYSFYNNVLTQQGIEFYNDICGIVNSHMNLYCQQTKEKSGQYRMRKLYKQILSISSTSYEVPYKYEDDAQVYSSINEFVDRIFNSNFSAKVEKMLGKAEEYDFDKIYISSKNYSSISNFISGKWNTLDDCIRRYYEDNTVGNGDKKEKKVEEKVKKDSFRSLDSIDKVVEMYEKRGKSAKEYIYQIREIYSDNKLYKFGQDGSDTVKLIENDAKIERIKCVLDMLLNTNRFLDTFAVGDGEAVDVGFYSEIDELKEIIDGIEPLYNRVRNYVTRKPYNKNKIKLNFNSPTLAEGWSKSKEYDDNAIILRRDGKYYLGIFNVKNKPDKKIMEGYSGDVGDGYEKMVYSLLSNIHSNFPRIFIKSDECEKKYKLSQYIIDGYDNDRHIKSSKNFDIKFCHDLIDYFKASINANPDWKVFDFKFSDTKSYEDISGFYSEVEKQGYKISWVNISKEDIDRLDETGQIYLFQIYNKDFSESSMGTPNLHTLYFKNLFSEENIRETVLKLSGKGELFFRKASIDKPSGHRKGSILVNKTYKTNIGNEEVRVPIPDKEYMEIYTYLNNGRTTKLSENAQSLLDNKLVEYFEAEKEIIKDRRYTVDKFFIHTSVVINYNAEGASDKQLNEQVLEYISKQDDMHIIGIDRGERNLVYVSVIDMKGRIVEQKSYNVVNSYSYQKKLVEREKARDEARKSWKEVGRIKDLKDGYLSLVVHEIADMVIKYNAIIAMEDLNYGFKRGRFKIERQVYQKFESMLISKLSYLVDKTKKADEPGGVLKGYQLAFVPKDVKKVGRQCGIIFYVPPAYTSKIDPATGFVDLFKFKSGEKEGTARADNDRKEFLSKFDDIRYVEKNDNREEMFAFTFAYDNFAMHNTVIAKKKWTAYTFGSRIQKVYENGRYTSNTREIELTDKMKRLLNENNIEYGDGHNLVDDIRTLDVDRSGAVINEIFKIFRLTVQLRNSKSEAENEKNGEYDRIISPIMNDAGEFFDSFKYKKMNEETEPGKHNATMPIDADANGAYCIAMKCLYEAKNIKSGWEKEGKKNNDLLCVTNADWFDFMQNKRYV

SEQ ID NO: 311 - protein, 1334 aa, unidentified; identical to SEQ ID NO: 209

SEQ ID NO: 312 - protein, 1234 aa, unidentified
MKNLSAFTNFYQLSKTLRFELIPQGKTLEYIEKNGLLVQDTRRADSYKLVKKIIDEYHKDFIEKALDGLEINLLEDYFMYYHIQKKDDNQKKQFEEIQTKMRKQISDKLSKNERYKNLFGKELIKDDLKVFVQNVEELELVKEFENFTTYFTGFHENRKNMYSAEDKSTAIAFRLIHQNLPKFIDNMGAFDKIRNSSLIDKFELIISDSQLGPIIQVLSVEDAFKLAYFNHTLTQTGIDKYNQLIGGYTSEDGKIKIQGLNEYINLYNQNIKDKNQKLPKLKPLFKQILSDRSTASFIPEQFENDNAVLESIEKLYQELNVHVFSGAHSLKELLQNISDYDLTKVYLRNDTSLTDISQKIFGDWGVIQKAINLHYDQHYTGKKKFGTEQYDDERKKALKQESYSIGYLNQCISLLPKEMETPKIETYFSLLGKTETNANYFELIENQYNDVSDLLNSPYSLDKDLAQQQTDVDKIKALLDSIKNLQWFIKPLFGKGNEAEKDERFYGEFAMLWETLDQITPIYNKVRNYMTRKPYSTEKIKLNFENSTLLDGWDVNKEVDNTSLIFRKDGLFFLGIMDKKHNKLFKKEFETITGATYEKMEYKLLPGANKMLPKVFFSNSRIDEFNPSPQLLENYKNETHKKGETFDLNDCHQLIDFFKSSINKHEDWKKFDFHFSETSSYQDLSGFYREVEQQGYKLSFKSIPESYIHQMVDEGKLYLFQIYNKDFSPYSKGTPNMHTLYWKMLFDADNLKNVVYKLNGQAEVFYRKASIKKENIVIHKAHEAVKNKNEANEKKQSMFEYDLIKDKRYTVDKFQFHVPITMNFKARGLNNINTEVNEFLRHEHGVHIIGIDRGERHLLYLTLIDSQGTIVEQYSLNEIVNEYNGNTYRTNYHDLLDRKEGNREEERRNWKTIENIKDLKEGYLSQVIHKISELMIKYNAIVVLEDLNGGFIRGRQKVEKSVYQQFEKMLIDKLNYLVDKKKTVSELGGTLNAYQLTNKFESFQKMGKQSGFLFYVPAWNTSKIDPVTGFVNFLDTRYETIDKAKALFAKFKDIRFNSEKNYFEFVIDNYTQFNPKAEGTRQNWTICSYGTRIETWRNPEKNNQWDSREITITDEFKKLLPSVDVALPQFIAQQTDKAFFERLLHVLKLTLQMRNSITNSEVDYLISPVADENGLFFDSRNAIKQLPTNADANGAYNIARKGMWVVEQIKNPTTDLKKMNLAISNRDWLKFVQK

SEQ ID NO: 313 - protein, 1262 aa, unidentified
MKTFQQFSRVYPLSKTLRFELKPIGSTLEHINKNGLLDQDQHRAKSYIQMKNIIDEYHKEFIEDVLDDLELQYDNEGRNNSISEFYTCYMIKSKDDNQRKLYEKIQEELRKQIANAFNKSDIYKRIFSEKLIKEDLKNFITNQKDNDKREQDIQIIEEFKNFTTYFTGFHENRKNMYTSEAQSTAIAYRLIHENLPKFIDNIMVFDKVAASPIADSFSELYTNFEECLNVMSIEEMFKLNYFNVVLTQKQIDVYNAIIGGKTIDNTNIKIKGLNEYINLYNQQQKDKSARLPKLKPLYKQILSDRNAISWLPEQFESDDKLLEAIQKAYQELDEQVLNRKIEGEHSLRELLVGLADYDLSKIYIRNDLQLTDISQKVFGHWGVISKALLEELKNEVPKKSKKESDEAYEDRLNKVIKSQGSISIAFINDCINKQLPEKQKTIQGYFAELGAVNNETIQKENLFAQIENAYTEVKDLLNTPYTGKNLAQDKVNVEKIKNLLDAIKALQHFIKPLLGDGTEPEKDEKFYGEFAALWEELDKITPLYNMVRNYMTRKPYSTEKIKLNFENSTLMDGWDLNKEQANTTVILRKDGLYYLAIMNKKHNRVFDVKAMPDDGDCYEKMEYKLLPGANKMLPKVFFSKSRIQEFAPSSQLLENYHNDTHKKGVTFNIKDCHALIDFFKASINKHEDWCKFGFRFSPTETYEDLSGFYREVEQQGYKISFRNVSVDYIHSLVEEGKIFLFQIYNKDFSPYSKGTPNLHTLYWKMLFDEKNLADVVYKLNGQAEVFFRKSSINYEQPTHPANKAIDNKNELNKKKQSLFTYDLIKDKRYTIDKFQFHVPITMNFKSTGNDNINQSVNEYIQQSDDLHIIGIDRGERHLLYLTVINLKGEIKEQYSLNEIVNTYKGNEYRTDYHDLLSKREDERMKARQSWQTIENIKELKEGYLSQVVHKIAELMIKYNAIVVLEDLNAGFMRGRQKVESSVYQKFEKMLIDKLNYLADKKKQPEEPGGILNAYQLTNKFVSFQKMGKQCGFLFYTQAWNTSKIDPVTGFVNLFDTRYETREKAKTFFGKFDSIRYNDEKDWFEFAFDYTNFTSKADGSRTNWKLCTYGKRIETFRDEKQNSNWTSKEVVLTDKFKEFFKESNIDIHSNLKEAIMQQDSADFFKKLLYLLKLTLQMRNSETGTNVDYMQSPVADEEGNFYNSDTCDSSLPKNADANGAYNIARKGLWIVQQIKTSDDLRNLKLAITNKEWLQFAQRKPYLDE

SEQ ID NO: 314 - protein, 1257 aa, unidentified
MFIMTSLKRFTRVYPLSKTLRFELKPVGKTLDHIVSSGLLEQDQHRAGSYVEVKKIIDEYHKAFIESSLDDFELQYYNEGKNNSLEEFYSYYMCRSKDETQKKLFEENQDKLRKQIADRLSKDERFKRIDKKELIEKDLIDFVKKPEERQLLEEFKGFTTYFTGFHENRKNMYSAEAQSTAIAYRLIHENLPKFIDNIMVFDKVAASPVADSFAELYANFEEYLNVTEIAEMFNLAYYNVVLTQSQIDVYNAIIGGKTFENGVKIKGLNEYINLYSQQQKDKSARLPKLKPLYKQILSDRNAISWLPEYFSEDEKLLEAIQKSYQELDEQVFNRKREGEHSLKELLLGLEGFDLSKIYIRNDLQLTDISQKVYGSWSVIQKALLEELKGEVQKKSKKETDEAYEDRLNKILKSQGSISIALINDCVHKLNSEEQNTIQGYFATLGAVDNQILQKENLFVQIENAYTEIKDLLNTPYQGRNLAQDKVNVEKIKNLLDSIKSLQHFVKPLLGDGSEAEKDEKFYGEFVALWDELDKITPLYNMVRNYMTRKPYSTEKIKLNFENSTLMDGWDLNKEQANTTVILRKDGLYYLAIMNKKNNKVFDVKNISSKGECYEKMEYKLLPGANKMLPKVFFSKSRIHEFAPSEQLLENYNNETHKKGATFNLSDCHALIDFFKASINKHEDWSKFGFNFSDTSSYEDLSGFYREVEQQGYKISFRNVSVDYVDSLVEEGKIYLFQIYNKDFSLYSKGTPNLHTLYWKMLFDEKNLADVVYKLNGQAEVFFRKSSINYERPTHPANQPIDNKNPQNEKKQSVFNYDLIKDKRYTVDKFQFHVPITMNFKSTGSENINQSVNEHIQKSDDLHIIGIDRGERHLLYITVIDLKGRIKEQFSLNEIVNHYNGKNHCTDYHALLSKREEERMKARQSWQTIESIKELKEGYLSQVVHKISELMVKYNAIVVLEDLNMGFMRGRQKVEASVYQKFEKMLIDKLNYLADKKKGPEEEGGILNAYQLTNKFVSFQKMGKQSGFLFYVPAWNTSKIDPVTGFVNLFDTRYETREKAKAFFAKFESIRYNEDKDWFEFAFDYSKFTSKADGSCTKWTVCTYGKRIETFRDEKQNSNWVSKEVCLTEKFKDFFAKYGIELRSNLKEYIISQDSADFFKGLLSLLKLTLQMRNSETGTDVDYLQSPVADANGEFYNSENCDESLPENADANGAYNIARKGLWVVKQIKGADDLKNLKLAISNKEWLQFVQAKPYLND

SEQ ID NO: 315 - protein, 1261 aa, unidentified
MASFSKFCGLYQLSKTLRFELKPIGKTKENIEKNGILERDSERATAYKAVKKVIDEYHKSFIELKLADLVLMQNQLEEFYMLYHLPTSDQKRKTDLPKIQESLHKQISDRFVKDDYYKRLFGKELIREDLTEFVSTPYYEKIIRSVPGNEQLSNEEVKLIQENTQREIAQFNDFTTYFVGFYDNRRNMYVAEDKATSIAHRMINENLPKFVDNMDVFEKIAASDVSQHFDELYKAMEPYLNVCNLADMFKLDYFSMVLTQTQIDVYNAIIGGKTLDDGTKIQGLNEYVNLYNQQQKDKTKRLPKLKPLFKQILSERNAISWLPEEFENDNDMLQSIEKCYQDLNEQVFGALKLLLTNIKDYDLEHIYLPNDLQLTDISQKHFGNWSVIKNAVLEETLSANPKKKSESGEKYDERIAKLLKSNDSYSIGFINDLLKSKIDDYKPLENYFAEMGAEDNENGQKLNHFARIGNAYTEIKTLLNTTYPEGKSLSQDKANVEKIKNLLDAIKNLQHFVKPLLGSGTESEKDNRFYGDFAPLWETLDQITPLYNMVRNRMTKKPYSEEKIKINFDNSTLLSGWDLNKEPDNTCTILRKDGLYYLAIMNKKNNKVFDVKNLVSNGECYEKMEYKLLPGANKMLPKVFFSKSRVDEFKPSEKLLSNYEKGTHKKGDNFSIDDCHALIDFFKKSIEKHEDWCKFGFDFSNTKSYEDLSGFYREVEQQGYKISFRNVSVDYIDQLVDEGKIYLFQIYNKDFSPFSKGTPNMHTLYWKALFDERNLTDVVYKLNGEAEVFFRKHSLVAAKPTHPANWPIANKNVQNKKKESTFAYDLIKDRRYTVDKFQFHVPITMNFKALGLNNINSLANAHLKESNATHIIGIDRGERHLLYLSLIDLKGNIVEQYSLNEIVNEYNGNTYRTNYHNLLDSKEKQRNEARRSWQTIENIKELKEGYMSQVVHKIAELMVKYNAIVVLEDLNLGFMRGRQKVEKQVYQKFEKMLIDKLNYLVDKKLDADATGGVLNAYQLTNKFESFQKMGKQSGFLFYIPAWNTSKMDPTTGFVNLFDTRYENMEKAKAFFGKFDSIRFNSAKGWFELAFDYDNFTTKAEGTQTKWTLCTYGTRIETKRNSEKNNEFDSVEFDLTERIKKLFAKYKLDLNGNLKEQICNQSDASFFKDLLHLLHLTMQMRNSITGTATDYLLSPVMNSKGEFFDSRHCGKNLPENADANGAYNIARKGLWVIEQIKQSDDVTKIKLAISNKDWMRYAQNSR

SEQ ID NO: 316 - protein, 1261 aa, unidentified
MASFSKFCGLYQLSKTLRFELKPIGKTKENIEKNGILERDSERATAYKAVKKVIDEYHKSFIELKLADLVLMQNQLEEFYMLYHLPTSDQKRKTDLPKIQESLHKQISDRFVKDDYYKRLFGKELIREDLTEFVSTPYYEKIIRSVPGNEQLSNEEVKLIQENTQREIAQFNDFTTYFVGFYDNRRNMYVAEDKATSIAHRMINENLPKFVDNMDVFEKIAASDVSQHFDELYKAMEPYLNVCNLADMFKLDYFSMVLTQTQIDVYNAIIGGKTLDDGTKIQGLNEYINLYNQQQKDKTKRLPKLKPLFKQILSERNAISWLPEEFENDNDMLQSIEKCYQDLNEQVFGALKLLLTNIKDYDLEHIYLPNDLQLTDISQKHFGNWSVIKNAVLEETLSANPKKKSESGEKYDERIAKLLKSNDSYSIGFINDLLKSKIDDYKPLENYFAEMGAEDNENGQKLNHFARIGNAYTEIKTLLNTTYPEGKSLSQDKANVEKIKNLLDAIKNLQHFVKPLLGSGTESEKDNRFYGDFAPLWETLDQITPLYNMVRNRMTKKPYSEEKIKINFDNSTLLSGWDLNKEPDNTCTILRKDGLYYLAIMNKKNNKVFDVKNLVSNGECYEKMEYKLLPGANKMLPKVFFSKSRVDEFKPSEKLLSNYEKGTHKKGDNFSIDDCHALIDFFKKSIEKHEDWCKFGFDFSNTKSYEDLSGFYREVEQQGYKISFRNVSVDYIDQLVDEGKIYLFQIYNKDFSPFSKGTPNMHTLYWKALFDERNLTDVVYKLNGEAEVFFRKHSLVAAKPTHPANWPIANKNVQNKKKESTFAYDLIKDRRYTVDKFQFHVPITMNFKALGLNNINSLANAHLKESNATHIIGIDRGERHLLYLSLIDLKGNIVEQYSLNEIVNEYNGNTYRTNYHNLLDSKEKQRDEARRSWQTIENIKELKEGYMSQVVHKIAELMVKYNAIVVLEDLNLGFMRGRQKVEKQVYQKFEKMLIDKLNYLVDKKLDADATGGVLNAYQLTNKFESFQKMGKQSGFLFYIPAWNTSKMDPTTGFVNLFDTRYENMEKAKAFFGKFDSIRFNSAKGWFELAFDYDNFTTKAEGTQTKWTLCTYGTRIETKRNSEKNNEFDSVEFDLTERIKKLFAKYKLDLNGNLKEQICNQSDASFFKDLLHLLHLTMQMRNSITGTATDYLLSPVMNSKGEFFDSRHCGKNLPENADANGAYNIARKGLWVIEQIKQSDDVTKIKLAISNKDWMRYAQNSR

SEQ ID NO: 317 - protein, 1240 aa, unidentified
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHENRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFENSTLMDGWDVNKETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFQFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 318 - protein, 1258 aa, unidentified
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHENRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLDGWDLNKETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 319 - protein, 1252 aa, unidentified
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHENRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNKEQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 320 - protein, 1263 aa, unidentified
MKTLKNLTGLYSLSKTLRFELKPIGKTKENIEKNGILERDNERAIAYKAVKKVIDEYHKAFIELMLDDFELNKDTLNEFYYLYHLPTSEAKRKTDLPKVQEVLRKQISERFTKSEQFKRLFGKELIREDLVEFVKTPQYENIIRKMPGNEQLTDKEVKQIQERVQKDIAQFDDFTTYFSGFYDNRKNMYVPEDIATSIAHRMIGENLPKFIDNMDVFARIAASDVATHFDELNKAMELYLNVNEIPEMFQLDYFHMVLTQKQIDVYNAIIGGKVLDDGTKVQGLNEYVNLYNQQQKDKSKRLPKLKPLFKQILSERNAISWLPDEFDSDNEMLQSIGKCYHDLKEQVFGSLKTLLGSIKDYDLEHIYLPNDLQLTDIAQKHFGDWSVIKNAVIENLQSVNPKKKRENGENYDERILKLQKANDSYSIGFINALLRSKTDDFNPLENYFAGMGAEDNENGQKLNHFARIENAYTEVKTLLNADYPEGKSLSQDKANVEKIKNLLDSIKDLQHYVKPLLGSGMESDKDNRFYGEFTPLWEALDQITPLYNMVRNRMTQKPYSDEKIKLNFDNSTLLAGWDLNKEADNTCTLLRKDGNYYLAIINKRSNKVLKPENLISDGDCYEKMEYKLLPGANKMLPKVFFSKSRIDEFKPSESVLKNYQKETHKKGDNFNLDDCHALIDFFKESINKHEDWSKFGFHFSDTNSYEDLSGFYREVEQQGYKISFRNVSVNYINQLVDEGKIYLFQIYNKDFSPYSKGTPNMHTLYWRMLFDERNLADVVYKLNGEAEVFFRKHSIRVDKPTHPANKPIANKNAQNEKKESIFTYDLVKDRRYTVDKFQFHVPITMNFKAAGLNNINPLVNAYLKESNSTHIIGIDRGERHLLYLSLIDMKGNIVEQYTLNEIVNEYKGNTYRTNYHDLLDAKEKQRDEARRSWQTIENIKELKEGYMSQVIHKIAELMVKHNAIVVLEDLNMGFMRGRQKVEKQVYQKFEKMLIDKLNYLVDKKLDAEEMGGVLNAYQLTNKFEGFQKLGKQSGFLFYIPAWNTSKMDPTTGFVNLFDTRYENMEKSKVFFGKFDSIRYNSAKGWFEFAFDYGNFTAKAEGTRTNWTLCTYGTRIETKRNPEKNNEFDSVEIDLTEQFKALFAKHQIDLSGNLKEQICNQSDASFHKELLHLLHLTLQMRNSVTNSEVDFLLSPVMNASGEFYDSRTCGKNLPENADANGAYNIARKGLWIIEQIKNTNDNDLAKIKLAISNKEWLRYAQGLD

SEQ ID NO: 321 - protein, 1262 aa, unidentified
MKRFKNLYPLSKTLRFELIPQGKTLDNIQSSGLLEQDEHRAESYQKVKTIIDEYHKAFIERVLDEFNLVYSDEGKKNSLEEFYSCYMCKSKDENQRKLYEKIQDELRKQIANAFNKSESLKRIFSEKLIKEDLKRFVSTLNDYDKDKREQEIRSIEEFQNFTTYFTGFYENRKNMYSSEAQSTAIAYRLIHENLPKFIDNILIFDKIAASPVAEKLGEVYVDFQEYLNVENIAEMFSLSYFNKVLTQTQIDVYNAIIGGKTLENTNRKKIKGLNEYINLYNQQQKDKSARLPKLKSLYKQILSDRNAISWLPEQFESDEKLLEAIEIAYQELNEHVLNKSSEGEHSLKELLCTLADYDLNKIYIRNDLQMTDISQKVFGHWGVISKALLEELKGDKSKKSKKESDEAYEERLNKIIKSQGSISIAHINESVCKQNAEEQNTLQGYFSTLGAVENEATQKENLFAQIENAYKEVKDLLNTPYHGKNLAQDKVNVEKIKKLLDAIKALQYFVKPLLGDGTEPEKDEKFYGEFAALWEDLDKITPLYNMVRNYMTRKPYSTEKIKLNFENSTLMNGWDLNKEHDNTSVILRKDGLYYLAIMNKKYNRVFDVNNISESGECFEKMEYKLLPGANKMLPKVFFSKSRIEEFAPSKQLLENYKNETHKKGATFKLNDCHALIDFFKASINKHEDWNKFGFQFSDTNTYEDLSGFYREVEQQGYKITFRNVSVDYINSLVEEGKIYLFQIYNKDFSPYSKGTPNLHTLYWKMLFDEKNLADVVYKLNGQAEVFFRKSSIEYKHPTHPATQPIDNKNALNKKKQSTFKYDLVKDKRYTVDKFQFHVPITMNFKSTGSDNINLLVNEYIQQSDDLHIIGIDRGERHLIYLTVIDMKGQIKEQYSLNEIVNTYNGNDYHTNYHDLLSKREEERMKARQSWQTIENIKDLKEGYLSQVIHKISELMVKYNAIVVLEDLNMGFMRGRQKVESSVYQKFEKMLIDKLNYLADKKKRPEEEGGILNAYQLTNKFTSFQKLGKQSGFLFYTQAWNTSKIDPVTGFVNLFDTRYETREKSKSFFGKFDSIRYNNEKDWFEFTFDYTNFTTKADDTRTNWTLCTYGKRIETFRDETQNSNWVSKEIELTNKFKEFFGKYHIDIQSNLKEVIVQQDTAEFFKGLLHLFKLTLQMRNSETGTNVDYMQSPVADANGNFYNSDTCDDSLPKNADANGAYNIARKGLMIIDKIKRSDDLKKIDLKISNKEWLHFAQNKPYLSE

SEQ ID NO: 322 - protein, 1250 aa, unidentified
MASLKKFTRLYPLSKTLRFELIPLGLTADHIGKSGILSQDEHRAESYKKVKKIIDEYHKAFIEKVLNNIHLQYDNIEQNNSLEEYFLYYMIKNKDEKKEKIFEEIQKKLRKQIADRFIDDPSFKNIDKKELIRSDLKDFVCSQEDLQLVDEFKDFTTYFTGFHENRKNMYSSEAQSTAIAFRLIHENLPKFIDNIQVFNKVAASSVSEFFTELYANFEECLTVTEIAEMFKLEYFNSVLTQKQIDVYNFILGGKSIEGGSKIKGLNEYINLYNQQQKDKSKRLPKFKPLFKEILSDRNSISWLPEKFKSDEEVLETIEKAYQELNEHVLNRNVGGEHSLKELLVRLEDFNLDKIYVRNDQQLTDISQKIFGHWGTISKALLEELKNEVPKKSNKETDEAYEERLNKILKSQGSVSIALINNSIQKLNIEEKKTVNSYFSLNSNICPKDNLYTRIENAYLEVKDLLNTPYTGKNLAQDKLNVEKIKNLLDAIKSLQHFVKPLLGDGKEPEKDEKFYGEFLSLWEELDKITPLYNMVRNYMTQKPYSTEKIKINFENSTLMDGWDVNKERDNTSVILRKDGLYYLAIMNKKNNQVFDAHNTPSNGICYEKMEYKLLPGANKMLPKVFFSKSRIHEFAPSKKLIENYKNETHKKGTTFNLDDCHKLIDFFKTSIKKHEDWNRFEFKFSDTTTYEDLSGFYKEVEQQGYKISFRNVSADYIDNLVKEGKIYLFQIYNKDFSPYSKGTPNLHTLYWKMIFDERNLANVVYKLNGQAEVFFRKSSISYDKPTHPANQEIDNKNILNKKKQSIFSYDLIKDKRYTVDKFQFHVPITMNFKSTGQDNINLSVNEYIRQSDDLHIIGIDRGERHLLYLTVIDLEGRIKEQYSLNEIVNIYNGNEYHTNYHDLLSKREDEREKARQSWQTIENIKDLKEGYLSQVIHKISELMIKYNAIVVLEDLNIGFMRGRQKVEASVYQKFEKMLIDKLNYLANKKIDPEEEGGILNAYQLTNKFTSFQKIGKQSGFLFYTQAWNTSKIDPSTGFVNLFDTRYETREKSKMFFSKFDSIKYNKDKDWFEFIFDYTNFTTKAEGTRTQWTICSYGKRIETLRDENKNSNWVSTEIDLTQSFKNFFTKYGIDINDNLKEFIVQQDTSEFFKGILYLFKLTLQMRNSAIGKDIDYIISPIADEKGIFYNSNECDSSLPKNADANGAYNIARKGLYIVRKIKHSDELKNLNLAITNKEWLQFAQSKPYINK

SEQ ID NO: 323 - protein, 1255 aa, unidentified
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDEMQKRQFADIQDKLRKQITQRFSDDDRFKRIDKKELIKEDLLSFVEDVEKRQLIEEFKDFTTYFTGFHENRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGKKIQGLNEYINLYNQQQKDKSARLPKLKPLYKQILSDRNAISWLPEQFQSDEKVLEAIQKAYQDLEEQVFNRKKEGEHSLKDLLLSLSDYDLSKIYIRNDTQMTDISQKAFGHWDVIHKALLEQLKEDVQKKPKKESDEAYEERLNKIIKSQGSIPIALINQGVQKQNSEEQNTLQTYFASLGAVETESVKKENLFTQIENAYAEVKDLLNTPYSGKNLAQDNVAIEKIKTLLDTIKALQHFVKPLLGDGTESEKDEKFYGEFSMLWEELDKITPLYNMVRNYMTRKPYSTEKIKLNFENSTLMNGWDLNKEQDNTTVILRKDGMYYLAIMNKKHNRVFDVKNISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLADVVYKLNGQAEVFFRKSSIICDKPTHPANQPIDNKNALNNKQQSVFEYDLVKDKRYTVDKFQFHVPITMNFKSTGGDNINLLVNEYIRQSDDLHIIGIDRGERHLLYLTVIDLQGRIKDKEQYSLNKIVNTYNGDEYPTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFDSFQKLGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASQGINLTDKFKELFAKYKIDIQADLKEAISQQDSADFFKGLLYLLKLTLQMRNSEIGTEIDYMQSPVADANGNFYNSDTCDDSLPKNADANGAYNIARKGLWIVQQIKAADDLKNVKLSISNKEWLKFAQEKPYLNE

SEQ ID NO: 324 - protein, 1266 aa, unidentified
MTSFSKFCGLYPLSKTLRFELKPIGKTKENIEKNGILERDSERATAYKAVKKVIDEFHKSFIELQLNDFELEQSKLEEFYHLYHLPTSDQKRKNDLPKVQESLRKLISERFTKNDYYKRLFGKELIREDLTDFVNTPYYENIIRNVPGNEQLSDEKVKQIQENTIREISQFNDFTTYFVGFYDNRKNMYVAEDKATAIAYRMINENLPKFIDNMDVFEKIAASDVAQHFGELYKEMEPYLNVSEIAEMFHLNYFSTVLTQTQIDVYNAIIGGKTLDDGTKIQGLNEYVNLYNQQQKDKSKRLPKLKPLFKQILSERNAISWLPDEFKNDNEMLQSIEKCYQDLKEQVFGALKQLLTTIKDYNLQHIYLPNDLQLTDISQKQYGSWSVIKNAIIEDLKKTNQPKKKEDAEDFENRLSKLADSYSIAYINQVTGSNIENFKPIEDYFAKMGAEDNENGQKLNHFARIENAYTEIKQLLNSEYPTGKSLSQDKANVEKIKNLLDAIKDLQHFVKPLLGSGTESEKDNSFYGEFTPLWENLDQITPLYNMVRNRMTKKPYSEEKIKINFDNSTLLAGWDLNKEADNTCTLLRKDGNYYLAIIDKRHNKVLKAENLSSDGECYEKMEYKLLPGANKMLPKVFFSKSRIAEFKPSEKIIRNYENETHKKGDKFNLADCHALIDFFKESIKKHEDWSKFGFNFSPTNSYEDLSGFYREVEQQGYKISFRNISVNYINKLVDEGKIYLFQIYNKDFSPFSKGTPNMHTLYWKALFDEKNLADVVYKLNGEAEVFFRKHSLNGAKPTHPANQPIANKNAQNEKKQSTFAYDLIKDRRYTVDKFQFHVPITMNFKAAGINNINPLVNEYLKESNATHIIGIDRGERHLLYLSLIDLKGNIVEQYSLNEIVNEYNGNTYRTNYHNLLDAKEKQRDEARRSWQTIENIKELKEGYMSQVIHKIAELMVKYNAIVVLEDLNLGFMRGRQKVEKQVYQKFEKMLIDKLNYLVDKKLDADATGGVLNAYQLTNTYKVFHDQYKKQQNTIGKQCGFLFYIPAWNTSKMDPTTGFVNLFDTRYENMEKAKAFFGKFDSIRFNSVKGWFEWAFDYDKFTTKAEGTQTKWTLCTYGTRIETKRNPEKSNEFDSVEFDLTERIKELFAKYQIDANGNLKEQICSQTDATFFKELLHLLHLTLQMRNSITGTETDYLISPVMNAKGEFYDSRVCGKDLPENADANGAYNIARKGLWVIEQIKHADDLTKPKLAISNKEWMRYAQGLK

SEQ ID NO: 325 - protein, 1278 aa, unidentified
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHENRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFENSTLLDGWDVNKEPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFQFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 326 - protein, 1236 aa, unidentified
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNENRKNMYSNEEKSTAIAFRLIHENLPKHMDNVSIFERLKTSKVSEDFALLSKELKEELSGKSLEDFFLIESYTKLLSQSQIDNYNVLIGGKSLEKNKKIKGLNEYINLYNQKQKESKDRLPKLKMLYKQILSDRGVLSWLPETFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLNGWDLNKERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYEDLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKLNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFRLTLQLRNSISNTDVDYIISPVANENGVFYNSKECDESLPQDADANGAYNIARKGIMIVERIKANKKGKKLDLAISNKDWLKFAQEKPYRK

SEQ ID NO: 327 - protein, 1236 aa, unidentified
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNENRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLNGWDLNKERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 328 - protein, 1252 aa, unidentified
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNKNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFENSTLLNGWDLNNERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFQLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 329 - protein, 1234 aa, unidentified
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHENRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQNSTLLKGWDVNKERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYQFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 330 - protein, 1258 aa, unidentified
MKQFTNLFQLSKTLRFELKPIGNTKENIKKNGILERDNQRDIAYKAVKKVIDEYHKAFIEIMLNDFELQYEQLEEYFHLYHISNSEEPKKKEKLQKIQENLRKQISERFTKSEQYKRLFGKELIKEDLSEFVKTPQFGNYIRAQKGDEYTDEQVRQIQERTLEDIDLFKDFTTYFVGFYENRKNMYVADDKATSIAHRMIDENLPKFIDNMKTFAEIAESDVAEHFADIYTAMESYLNVNDIREMFQLDYFSMVLTQKQIDVYNAIIGGKTLADGTKIQGLNEYVNLYNQQQKKKEDRLPKLKPLFKQILSERNAISWLPEEFKDDNEMLQRIEKCYQDLNAQVFGSLKTLLETLNDFDLDNIYLPNDLQLTDIAQKHYGSWAVINKAIEEDLKTGNPQKNRESGEKYEERIAKLLKANDSYSIGYINGLLKDRMENFKPLEVYFSNIGAEDDGKEQKLNHFARIENAYTEAKSLLTAEYPDDKRLSQDKVNVEKIKNLLDAIKDLQRFVKPLLGCGTESNKDSLFYGDFTPLWEQLDQITPLYNMVRNRMTQKPYSVEKIKINFDNSTLLAGWDLNKEADNTCTLLRKDGLYYLVIMDKSNSRVLKAENLISDGDCYEKMEYKLLPGANKMLPKVFFSKSRIGEFRPSESVQENYKNETHKKGDNFNIDHCHELINFFKKSIGKHEDWSKFGFKFSDTHTYRDLSGFYREVEQQGYKITFRNVSVDYINKLVDEGKIFLFQIYNKDFSPYSKGTPNMHTLYWKMLFDERNLADVVYKLNGEAEVFFRKKSVKVERPTHPANKPIANKNAQNNKKESTFAYDLIKDRRYTVDKFQFHVPITMNFKANGLSDINPLVNEYLKNSNATHIIGIDRGERHLLYLSLIDLKGNIVEQYSLNEIVNEYNGNTYRTNYHDLLDAKEKQRDEARRSWQTIENIKELKEGYMSQVIHKIAQLMLKYNAIVVLEDLNFGFMRGRQKVEKQVYQKFEKMLIDKLNYLVDKKRDANELGSVLNALQLTNKFESFQKLGKQSGFLFYIPAWNTSKMDPTTGFVNLLDTRYENMEKAKAFFGKFDSIRYNAQKDWFEFAFDYNNFHNKAEGTQTEWTLCTYGTRIETKRDAEQNNNFVSKEVCLTEQFKKVFDEHQIDINGNLKEQICSQTDASFFKALLNLLRLTLQMRNSITGTETDYLISPVQNAKGEFYDSRHCGKNLPENADANGAYNIARKGLWIIKQIQQAGDLSNIKLAISNKEWLQSAQKLE

SEQ ID NO: 331 - protein, 1242 aa, unidentified
MEETMSNFSDFTGLFSLGKTLRFELKPIGKTLENIEKKGLLAEDEKRAESYKKVKKLIDEYHKTFIENALSNLTEKEKDGLKKLLDEYFECYNSNRKDELVTCVADLRKHIAGIFKNENNKATFERIFGKELIREDLIKAVKSDEERKLIGEFNDFTTYFTGFNENRKNMYSAEEKSTAIAYRLINENLPKFIDNMKIFEKITQIDEIRSNIEELQKNLSSELNGAKVAEFFELSFYGSLLTQTQIETYNLILGGKSPKQGEKTKGLNEYINLYNQQQSEKKDRLPKFKPLFKQILSDRNAFSWIPEAFVSDNEVLEQIQKCYTELNSEEVDFFGNLRRLLKRTGDFDLKTIYISNDLQLTNISQQMFGSYAVIPNAIEEWFKRNNPPKSKEKAEKYEERIKKMTNAESYSIGFINECLKEAGEEKGVDQYFANCGEPENSRNDLLAEISKQYLNTRDLLNCSYPEGNKLAADKQNVEKIKNFLDAIKDLQRFVKPLVGSGTESDKNAEFYGEFSPLYENFNNFTLLYNKVRNYLTRKPYSTEKIKLNFKNSTLLNGWDLNKESDNTCVLLRKDGMYYLGIMDKNNNKIFASKEIKSDGDCYEKMVYKLLPGPNKMLPKVFFAASRINEFAPSDEILEIRKKETFKKGPNFKPEDLRKWINFMKESLRKNKDWQDFDFHFSDTSSYEDISQFYREVEQQGYKISFVNVSTSYINQLVDEGKLYLFQIYNKDFSSYSKGTPNIHTLYWRMLFDSSNLKDVVYKLNGEAEVFFRKKSITYNDEIQKHGHHYTELKDKFAYPIIKDRRYSLDKFQFHVPMTINFKAGNRDNINALVCDYIKESDDLNIIGIDRGERNLLYVTVIDLNGNIKEQISLNEIVSENKYDYRTDYHKLLDNREKERDAARRSWQSVENIKDLKSGYLSQVIHKISQLMIKYKAIVVLEDLNAGFMRGRQKVEKSVYEQFEKKLIDKLNFLVDKQVKDPNEPGGLFHAYQLTGKFESFKKLGKQSGMLFYVPAWNTSKIDPVTGFVNFFNTRYESIEKAKDFFSKFDSICYNPQKDHFEFAFDYKNFTVKAGDSQTKWSVCTIGSRIETFRNEKKNHNWDNREIDLTLEFKKHFETYKIALNSDLKAEIVRQTSKDFFQRLLYLFKLTVQMRNSITNSSTDYLISPVADKNGNHFDSRKSDKTLPQDADANGAYNIARKGLWLIRQIKQFEGSDWKKFKIEPIKNVAWLSFVQEEARKKG

SEQ ID NO: 332 - protein, 1242 aa, unidentified
MEEKMSNFSDFTGLFSLGKTLRFELKPIGKTLENIEKKGLLAEDEKRAESYKKVKKLIDEYHKTFIENALSNLTEKEKDGLKKLLDEYFECYNSNRKDELVTCVADLRKHIAGIFKNENNKATFERIFGKELIREDLIKAVKSDEERKLIGEFNDFTTYFTGFNENRKNMYSAEEKSTAIAYRLINENLPKFIDNMKIFEKITQIDEIRSNIEELQKNLSSELNGAKVAEFFELSFYGSLLTQTQIETYNLILGGKSPKQGEKTKGLNEYINLYNQQQSEKKDRLPKFKPLFKQILSDRNAFSWIPEAFVSDNEVLEQIQKCYTELNSEEVDFFGNLRRLLKRTGDFDLKTIYISNDLQLTNISQQMFGSYAVIPNAIEEWFKRNNPPKSKEKAEKYEERIKKMTNAESYSIGFINECLKEAGEEKGVDQYFANCGEPENSRNDLLAEISKQYLNTRDLLNCSYPEGNKLAADKQNVEKIKNFLDAIKDLQRFVKPLVGSGTESDKNAEFYGEFSPLYENFNNFTLLYNKVRNYLTRKPYSTEKIKLNFKNSTLLNGWDLNKESDNTCVLLRKDGMYYLGIMDKNNNKIFASKEIKSDGDCYEKMVYKLLPGPNKMLPKVFFAASRINEFAPSDEILEIRKKETFKKGPNVKPEDLRKWINFMKESLRKNKDWQDFDFHFSDTSSYEDISQFYREVEQQGYKISFVNVSTSYINQLVDEGKLYLFQIYNKDFSSYSKGTPNIHTLYWRMLFDSSNLKDVVYKLNGEAEVFFRKKSITYNDEIQKHGHHYTELKDKFAYPIIKDRRYSLDKFQFHVPMTINFKAGNRDNINALVCDYIKESDDLNIIGIDRGERNLLYVTVIDLNGNIKEQISLNEIVSENKYDYRTDYHKLLDNREKERDAARRSWQSVENIKDLKSGYLSQVIHKISQLMIKYKAIVVLEDLNAGFMRGRQKVEKSVYEQFEKKLIDKLNFLVDKQVKDPNEPGGLFHAYQLTGKFESFKKLGKQSGMLFYVPAWNTSKIDPVTGFVNFFNTRYESIEKAKDFFSKFDSICYNPQKDHFEFAFDYKNFTVKAGDSQTKWSVCTIGSRIETFRNEKKNHNWDNREIDLTLEFKKHFETYKIALNSDLKAEIVRQTSKDFFQRLLYLFKLTVQMRNSITNSSTDYLISPVADKNGNHFDSRKSDKTLPQDADANGAYNIARKGLWLIRQIKQFEGSDWKKFKIEPIKNVAWLSFVQEEARKKG

SEQ ID NO: 333 - protein, 1266 aa, unidentified
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHENRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFENTQLLKGWDLNKESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFQFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 334 - protein, 1276 aa, unidentified
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHQNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLNGWDANKEADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 335 - protein, 1238 aa, unidentified
MEELMTNFSDFTGLFSLSKTLRFELKPVGKTLENIEKKGLLAEDEHRADSYKKVKKLIDEYHKNFIENALSNLTEKEKEELRKLLDEYFECYNGNKKDDLVICATDLRKQIAGAFKNENNKETFERIFGKELIREDLLKTVKSDDECKLIGEFNDFTTYFTGFNENRKNIYSAEEQATAIAYRLINENLPKFIDNMKIFEKISQVEEMRSNIEELKKNLSNELNGRKIADFFEIAFYCSLLTQSQIENYNLIIDGKSPKQGEKIKGLNEYINLYNQRQTEKKNRLPKFKPLFKQILSDRNAFSWIPEAFNSDNEVLEDIEKCYRELNSDFERLHKLLKNIGDYELNTVYVSNDLQLTNISQQMFDHYAVIKNAIEEHFKKLNPQKNKEKSEKYEERIEKLMKEKSYSIGFINECLDEAGKEKGVDGYFANCGKTDSCSNDLFAKILVKHTEVLNLLNCSYPEGNKLAADKDSVEKIKNLLDAIKDLQRFAKPLIGAGTESDKNAEFYGEFSPLYEKFNEFTLLYNKVRNYLTKKPYSTEKVKLNFENSTLLNGWDLNKESDNTSVLLRKDGLYYLGIMDKKSNKIFSSKEIKSDGDCFEKMVYKLLPGPNKMLPKVFFAASRINEFSPSDEILEIRKKETFKKGPNFKPEDLHKWIDFMKESIRKNKDWQDFDFNFSDTSSYEDISKFYRDVEHQGYKVSFVNVSASYINQLVDEGKLYLFQIYNKDFSSYSKGTPNMHTLYWKMLFDSSNLKDVVYKLNGEAEVFFRKKSITYNEDIQKHGHHYNELKDRFAYPIIKDRRYSVDKFQFHVPMTINFKAGSQDNINSLVCDYIRESDDLNIIGIDRGERNLLYLTVIDLKGNIKEQLSLNEIVSENKDDYRTDYHALLDKREKERKEARRSWQSAENIKDLKSGYLSQVIHEISQLMIKYNAIVVLENLNMGFMRGRQKVEKSVYEQFEKKLIDKLNFLVDKKVKNPHAPGGLFHAYQLTSKFESFKKLGKQSGMLFYVPAWNTSKIDPVTGFVSFFDARYESIEKAKDFFSKFDSISYNPQKDHFEFAFDYNNFTAKAGDSQTKWIVCTIGSRIKTFRNEKKNNQWDNQEIELTPAFKKLFNDYEIALNSDLKAEITKQTGKDFFQKLLGLFKLTVQMRNSITNSSTDYLISPVADKNGNYFDSTKADKTLPQDADANGAYNIARKGIWLIRQIKQFEGSDWKKFKLEPIKNVEWLSFVQEKARKKS

SEQ ID NO: 336 - protein, 1242 aa, unidentified
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHKNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLGGWDVNKEPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 337 - protein, 1238 aa, unidentified
MEETMTNFSDFTGLFSLSKTLRFELKPVGKTRENIEKKGLLDEDEKRAESYKAVKKLIDEYHKTFIENALSSLTEKEKDEFRKLLDKYFEYYNSNKKDDLATCATDLRKQIAGVFKNENNKETFERIFGKELIREDLLKAVKSDDERKLIGEFNDFTTYFTGFNENRKNMYSADEKSTAIAYRLVNENLPKFIDNMKIFEKISQVEEMRSNVEELQKNLSNELNGRKAADFFDMAFYGSLLTQSQIENYNLIIDGKSPKQGKKIKGLNEYINLYNHQQTEKKNRLPKFKPLFKQILSDRNAFSWVPEAFNSDNEVLEDIEKCYRELNSDFEHLHSLLKRMGDYDLGTIYISNDLQLTNISQQMFDHYAVIKNAIEEHFKKLNPQKNKEKSEKYEERIEKLMKEKSYSIQFVNECLREAEKEKGVDEYFANCGKTDSCSNDLFAKILVKHTEVLNLLNCSYPEGNKLAADKDSVEKIKNLLDAIKDLQRFAKPLIGAGTESDKNAEFYGEFSPLYEKFNEFTLLYNKVRNYLTKKPYSTEKVKLNFENSTLLNGWDLNKESDNTSVLLRKDGLYYLGIMDKKSNKIFSSKEIKSDGDCFEKMVYKLLPGPNKMLPKVFFAASRINEFSPSDEILEIRKKETFKKGPNFKPEDLHKWIDFMKESIRKNKDWQDFDFNFSDTSSYEDISKFYRDVEHQGYKVSFVNVSASYITQLVDEGKLYLFQIYNKDFSSYSKGTPNMHTLYWKMLFDSSNLKDVVYKLNGEAEVFFRKKSITYNEDIQKHGHHYNELKDRFAYPIIKDRRYSVDKFQFHVPMTINFKAGSQDNINSLVCDYIRESDDLNIIGIDRGERNLLYLTVIDLKGNIKEQLSLNEIVSENRDDYSTDYHALLNKREKERNEARRSWQSAENIKDLKSGYLSQVIHKISQLMVKYNAIVVLEDLNMGFMHSRQKVEKSVYEQFEKKLIDKLNFLVDKKVKDPHAPGGLFHAYQLTSKFESFKKLGKQSGMLFYVPAWNTSKIDPVTGFVSFFDARYESIEKAKDFFSKFDSISYNPQKDHFEFAFDYNNFTAKAGDSQTKWIVCTIGSRIKTFRNEKKNNQWDNQEIELTPAFKKLFNDYEIALNSDLKAEITKQTGKDFFQNLLGLFKLTVQMRNSITNSSTDYLISPVADENGNYFDSTKADKTLPQDADANGAYNIARKGLWLIRQIKQFEGSDWKKFKLEPIKNVEWLSFVQEEARKKG

SEQ ID NO: 338 - protein, 1277 aa, unidentified
MTNFQSFTQKYALSKTLRFELKPIGKTKDHIEAKGLLAQDTNRASAYQKVKKIIDNYHKYFIDLAMQDVKLSKLSDFQELYFATADKKKDESYKIEVEKVQTDLRKEIVAGFKADRVKSIFDKLFKKELITEILPSWLDENGGSKELVAEFKTFTTYFTGFHENRKNMYSDKEQSTAIAYRLIHENLPKFLDNLKVFEKLKGVPELYAKCTQLYTDIEEYLNVRTIDEAFELAYFNEVLIQKQIDVYNLIIGGRTAVEGTTRIQGLNEYINLYNQTQQDRTSRVPKLKPLYKQILSDRESISFLQDKFDSSQEVLASINEYYHANVISFQSAENEGAENVLTRIKELLDDLNRYNLAQIYIRNDRSLTDISQALFGDFSIIKEALKFSFISTLEIEKKVLSKKQEESIEKYLKQSYFSIVEIETALQQYKGENDALKDLGENVIASYFKNNFKTKVNDKDYDLVANVTAKYSCVKGILESYPDDKKLNQEQKDIDNIKNFLDSLMLVLHFVKPLMLPKDSTLEKDANFYNTILPYYEQLQHLIPLYNKVRNFATQKAYSTEKIKLNFENSTLLDGWDVNKETDNTSILFRKGNDYFLGVMDKKHNNIFRNPPKANTDNTYSKVNYKLLPGASKMLPKVFFSAKNIGFYNPSEEIQNIRNHGTHTKSGTPQNGFEKKDFNLLDCRKMIEFFKDSIAKHPEWKQFGFNFSNTDSYDSIDGFYREVEAQGYTISYTEIDDEYINQLVEDGKLYLFQIYNKDFSEFSKGKPNMHTLYWKALFEPENLNDVIYKLNGQAEIFYRKKSIHDDKKIIHKANEKVANKNPLNTKKESLFAYDLVKDKRFTVDKFQFHVPITLNFKAKGNDFINQDVLSFLQNNPDINIIGLDRGERHLIYLTLINQKGEILQQFSLNDIVNEHNGETYKTSYKVLLDKKEKERADARENWGTIENIKELKEGYISQVVHKIAKMMVEYNAIVVMEDLNMGFKRGRFKVEKQVYQKLEKMLIDKLNYLVFKDKAPDEAGGLYKALQLANKFESFQKMGKQSGFLFYVPAWNTSKIDPTTGFVNLFFTKYESVEKAQKFFENFDSICFNMNEKFFEFAFDYNKFTERAAGTKTKWTVCTQGERILTFRNPETNNQWDNKEITLSEQFEDLFGKYNISYGDGTCIKAQIVAQNEAKFFKELMDLFKLSLQMRNSITNSELDYLISPVKNESGVFYDSRNADETLPKDADANGAYHIAKKGLMWLRQIHEFEGNDWKNLKFENTNKGWLNFVQNKNEKL

SEQ ID NO: 339 - protein, 1224 aa, unidentified
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNQNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDSPQLLDGWDKNKERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFQFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 340 - protein, 1282 aa, unidentified
MVGGNLQDEKFTNMYSLSKTLRFELKPIGKTLEHIEKKKLIRQDEKRAESYKKMKRTIDGFHRDFIELAMSQVKLTKLKAFAKLYNESSERKKEDDFKKKFEKVQADLRKEIAEGFKTGKAKETFSKIDKKELITELLPNWIRTQEGQNKNIYFDDKFKRFTTYFGGFHENRKNIYTDKEQSTAIAYRLIHENLPRFLDNIKTFEKIRLIPELYKECAILYEEIKEYLEITRINDAFKVDYYNKVLTQKQMDVYNLIIGGRTPKEGQKKIQGLNEQINLYNQKQNKNNQTPKFKQLYKQILSDRESASFLPEAFEESQEVLDSIRDYYQSNLIDYKPDDKDDTENILKKIKDLLVHLQNYDLNKIYLRNNKSITDISKTLFDDWSIIKSALEFAFLQTLEIGKKGLSKKQEKEKEKYLNQSHFSIADIEGALLAYKDEAEILKDLHDDTKPIVNYFHTHFKTEKKKDSDKEFDLIANIEAKYSCIKGILNTEYPKDKKLNHDKKVIDDIKAFLDSLMELLHFVKPLSLPSDSPLEKDEMFYVQFQTGYDQLRLLIPLYNKVRNYATQKPYSTEKFKLNFENSKLLAGWDLNKEADNTSVLFRKNGLYYLGIMDKEHNQIFKNIPDASPGKVVYEKMVYKLLPSPNKMLPKVFFSNRRINEFAPSEELKKKYKAGTHKKGDQFNIKDCRNLIDFFKESITKHEDWKRFGFQFSDTPSYEDLSGFYREVEHQGYKITFQNVPESYINQLVDEGKLFLFKIWNKDFSTYSKGNPNLHTMYWKALFDPKNLKDVVYKLNGQAEMFYRRKSISNDRSVVHKANKPIGNKNPNNTKKESVFEYDIIKDKRYTADKFQFHVPITLNFKAKGNEHINAYVLEYLKNNPEVKIIGLDRGERNLIYLTLIDQQGNIEEQYSLNDIINEHKGNTYQTNYRDLLGKKEDERAKARENWGTIETIKELKEGYISQAIHKIVQMMVKHNAIVVMEDLNFGFKRGRFKVEKQIYQKLEKKLIDKLNYLVFKGKADNEIGGLYHALQLTNKFVSFQKLGKQSGFLFYVPAWNTSKIDPTTGFVNLFNTRYENLEKARSFFNNFEDIRYNPAKDYFEFDVKEYSKFNSKADGTKQDWTICTYDVRIKTFRNPKKNNQWDNKEVVLSDEFKKLFQLNNVDYKTDLKKQIISQTEKTFFETLLNLFKLTVQMRNSKMQSWDDYLISPVMNSKEEFYDSRNAGKEFPQDADANGAYHIAKKGLWALQQISAHNEDWKSLKLTIGNKEWLQFVQEGTEQWNKI

SEQ ID NO: 341 - protein, 1235 aa, unidentified
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYENRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNKATLLNGWDISKERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFQFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 342 - protein, 1287 aa, unidentified
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHENRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNKEQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 343 - protein, 1271 aa, unidentified
MQSSKKRIIMKQFTNLYQLSKTLRFELKPIGKTKENIEKSGILERDNQRDIAYKAVKKVIDEYHKAFIEIMLNDFELQYEQLEEYFHLYHISNSEEPKKKEKLQKIQENLRKQISDKFTKSEQYKRLFGKELIKEDLSEFVNTSQFEHYIRTQKGNDLSDEQVRQIQERTLEDIDQFKDFTTYFSGFHQNRQNMYVADDKATSIAHRMIDENLPKFIDNMKTFAEIAESDVAEHFADIYSEMESYLNVNDIREMFQLDYFSMVLTQKQIDVYNAIIGGKTLADGTKIQGLNEYVNLYNQQQKKKEDRLPKLKPLFKQILSERNAISWLPEEFESDNEMLQSIEKCYQDLNTQVFGKLKTLLATLNDFDLDNIYLPNDLQLTDISQKHYGSWAVINKAIEEDLKTVNPQKKRESGEKYEERIAKLLKANDSYSIGYINSLLKSRMEKFKPLEVYFSNIGAEDDGKQQKLNHFARIENAYTEAKSLLTAEYPDDKKLSQDKNNVEKIKNLLDAIKDLQRFVKPLLGYGTESNKDSLFYGDFTPLWEQLDQITPLYNMVRNRMTQKPYSVEKIKINFDNSTLLAGWDLNKEADNTCTLLRKDGLYYLVIMDKSNSRVLKAENFISDGDCYEKMEYKQIALPMGVGAFVRKCYGTAQSYGWSCPKNCLNDEGKIIIKDDEAQPNLRCIIDCYKDFFDKYEKDGFKYKDFNFSFLESDKYEKLSEFFKEVEPQGYLIRFRNVSVDYINKLVDEGKIFLFQIYNKDFSPYSKGTPNMHTLYWKMLFDERNLADVVYKLNGEAEVFFRKKSVKVERPTHPANQPIANKNAQNNKKESTFAYDLIKDRRYTVDKFQFHVPITMNFKAAGLNNINPLVNEYLKMSNTTHIIGIDRGERHLLYLSLIDLKGNIVEQYSLNEIVNEYNGNTYRTNYHDLLDAKERQRDEARRSWQAIENIKELKEGYMSQVIHKIAQLMLKYNAIVVLEDLNFGFMRGRQKVEKQVYQKFEKMLIDKLNYLVDKKRDANELGGVLNALQLTNKFESFQKLGKQSGFLFYIPAWNTSKMDPTTGFVNLLDTRYENMEKAKAFFGKFDSIRYNAQKDWFEFAFDYNKFHNKAEGTQTQWTLCTYGTRIETKRDAEQNNNFVSTEVDLTQKFKALFAEKQIGPNGNLKEQICSQTDASFFKSLLNLLRLTLQMRNSITGTETDYLISPVQNAKGEFFDSRVCDANLPENADANGAYNIARKGLWVIEQMKQTDDLSNIKLAISNKEWMRFAQKNN

SEQ ID NO: 344 - protein, 1243 aa, unidentified
METFSGFTNLYPLSKTLRFRLIPVGETLKHFICSGILEEDQHRAESYVKVKSIIDDYHRAYIESSLSGFELPVESTGKANSLEEYYLYHNIRNKTDKIQKSLSTVRVNLRKLIVKQLTKNELYERIYKQNLIKEDLIDFVKNEPEANEKIALISEFRNFTVYFKGFHKNRKNMYSDKEKSTSIAFRLIHENLPKFIDNIEVFAKIQNTSISDNFDVIQKEFCPELVTLCEMFKLGYFNKTLSQKQIDAYNTVIGGKTTSEGKKIKGLNEYINFYNQQHKQEKLPKMKLLFKQILSDRESASWLPEKFENDSQVVGAMVNFWNTIHDTVLAEGGLKTIIASLGSYGLEGIFLKNNLQLTEISQKATGSWSKISSEIKQKIEVMNPQKKKESYEGYQERIDKLFKSYKSFSLAFINECLRGEYKIEDYFLKLGAVNSSSLQKENHFSHIFNTYTDVKDVIGFYSESTDTKLIQDNDSIQKIKQFLDAVKDLQAYVKPLLGNGDETGKDERFYGDLIEYLSLLDLITPLYNMVRNYVTQKPYSVDKIKINFRNPTLLDGWDLNKETANTSVILRRDDKYYLAIMNTKCRKVFLKYPSGTGKDCYEKMEYKFLESKSLWHVFFSKSRIGIFKPNNDILSIKSKSSYKESSDCFSLDDCHTLIDFFKKSLDKHDNWKNFGFKFSDTSTYEDMSGFYKEVENQGYKLSFKPIDAAYVDQLVDEGKIFLFQIYNKDFSEHSKGMPNMHTLYWKMLFNETNLGDVVYKLNGEAEVFFRKASINVSHPTHPANIPIKKKNLKHKDEERILKYDLIKDKRYTVDQFQFHVPITMNFKADGNGNINQKAMDYLRSASDTHIIGIDRGERNLLYLVVIDGNGKICEQFSLNEIEVEYNGEKYSTNYHDLLNVKENERKQARQSWQSIANIKDLKEGYLSQVIHKISELIVKYNAIVVLEDLNAGFMRGRQKVEKQVYQKFEKKLIEKLNYLVFKKQSSDLPGGLMHAYQLTNKFESFNTLGKQSGFLFYIPAWNTSKMDPITGFVNLFDVKYESVDKAKSFFSKFDSIRYNVERDMFEWKFNYGKFTKKAEGTKTDWTVCSYGNRIITFRNPDKNSQWDNKEINLTENIKLLFERFGIDFSSNLKDEIMQRTEKEFFIELIFLFKLVLQMRNSWTGTDIDYLVSPVCNENGEFFDSRNVDETLPQNADANGAYNIARKGMILLDKIKKSNGEKKLALSITNIEWLSFAQGCCKNG

SEQ ID NO: 345 - protein, 1243 aa, unidentified
METFSGFTNLYPLSKTLRFRLIPVGETLKHFICSGILEEDQHRAESYVKVKSIIDDYHRAYIESSLSGFELPVESTGKANSLEEYYLYHNIRNKTDKIQKSLSTVRVNLRKLIVKQLTKNELYERIYKQNLIKEDLIDFVKNEPEANEKIALISEFRNFTVYFKGFHKNRKNMYSDKEKSTSIAFRLIHENLPKFIDNIEVFAKIQNTSISDNFDVIQKEFCPELVTLCEMFKLGYFNKTLSQKQIDAYNTVIGGKTTSEGKKIKGLNEYINFYNQQHKQEKLPKMKLLFKQILSDRESASWLPEKFENDSQVVGAMVNFWNTIHDTVLAEGGLKTIIASLGSYGLEGIFLKNNLQLTEISQKATGSWSKISSEIKQKIEVMNPQKKKESYEGYQERIDKLFKSYKSFSLAFINECLRGEYKIEDYFLKLGAVNSSSLQKENHFSHIFNTYTDVKDVIGFYSESTDTKLIQDNDSIQKIKQFLDAVKDLQAYVKPLLGNGDETGKDERFYGDLIEYWSLLDLITPLYNMVRNYVTQKPYSVDKIKINFRNPTLLDGWDLNKETANTSVILRRDDKYYLAIMNTKCRKVFLKYPSGTGKDCYEKMEYKFLESKSLWHVFFSKSRIGIFKPNNDILSIKSKSSYKESSDCFSLDDCHTLIDFFKKSLDKHDNWKNFGFKFSDTSTYEDMSGFYKEVENQGYKLSFKPIDAAYVDQLVDEGKIFLFQIYNKDFSEHSKGMPNMHTLYWKMLFNETNLGDVVYKLNGEAEVFFRKASINVSHPTHPANIPIKKKNLKHKDEERILKYDLIKDKRYTVDQFQFHVPITMNFKADGNGNINQKAMDYLRSASDTHIIGIDRGERNLLYLVVIDGNGKICEQFSLNEIEVEYNGEKYSTNYHDLLNVKENERKQARQSWQSIANIKDLKEGYLSQVIHKISELIVKYNAIVVLEDLNAGFMRGRQKVEKQVYQKFEKKLIEKLNYLVFKKQSSDLPGGLMHAYQLTNKFESFNTLGKQSGFLFYIPAWNTSKMDPITGFVNLFDVKYESVDKAKSFFSKFDSIRYNVERDMFEWKFNYGKFTKKAEGTKTDWTVCSYGNRIITFRNPDKNSQWDNKEINLTENIKLLFERFGINFSSNLKDEIMQRTEKEFFIELIFLFKLVLQMRNSWTGTDIDYLVSPVCNENGEFFDSRNVDETLPQNADANGAYNIARKGMILLDKIKKSNGEKKLALSITNIEWLSFAQGCCKNG

SEQ ID NO: 346 - protein, 1242 aa, unidentified
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHENRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLGGWDLNKEPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 347 - protein, 1294 aa, unidentified
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHENRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKNSSLMKGWDLNKEEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFQFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 348 - protein, 1256 aa, unidentified
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNENRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYINLFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFENSTLLNGWDENKEEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFQFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 349 - protein, 1247 aa, unidentified
MEKTYSDLTNLYQLQKTLRFELKPIGNTLDNIERKGIIAQDEQRDKEYKEVKKIIDCYHKQFISMCLGNFKLKLASNGQGDSLEEYVTLASKANRSEKDSKAFEKVQENLRKQIVAAFKSGNTYTDLFKGELIKKHLPLAVTDVKEKQMVENFGKFTTYFTGFHENRKNMYSDEVKSTAIAYRLIHENLPRFIDNMKVFEAVAQTEVAERFVDIEVAFSEYLNVEHISEMFQLDYFSDTLTQAQIEVYNGIIGGRSENDVKIQGLNEYINLYNQQHKERKDRLPFLKPLYKMMLSDRMAVSWLPEEFTRDEEMLTVLNQMLEAIAPVLAPSGDKSLRTLLGNIADYDLAHIYIANNLGLTDISQQMFGQYDVFASAIKDELRKRFPRKKSGKEDDEAYDKRINDAFKSIKSFSIDYLNNLPQPEREDKKLLRVEDYFAKRKNIFEEIEEARDKASDILAGKHKTHLNQSEQDIRLLKKLLDALKGLQRFIKPLLGSGEEIDKDNVFDAKLCAAWDDALVIITPIYNKVRNWLTRKPYSTEKIKLNFENAQLLGGWDENKECDCTAILLRKADKYFLAIMDKKNNHAFDIEELPSEGDCYDKVVYKLLPGANKMLPKVFFSKSRIDEFNPSASLKAAYDAGTHKKGNSFCLSDCHRLIEFFKASIDKHEDWSKFPFQFSNTESYQDISGFYREVEQQGYMIDYRKVSVSFIDNLVNNGKLYLFQIWNKDFSEYSKGTPNMHTLYWKMAFDERNLADVIYKLNGQAEVFYRKRSLDVAKTTIHRANENIANKNSQNEKCESTFEYDIIKNRRFTVDKFQFHVPLTLNFKAVGKENINPAVQNIIREGGIEHIIGIDRGERHLLYLSLIDLKGYIVKQMTLNDIVNEYKGNTYTTKYKDMLAQREVNRTEARETWQKIEDIKNLKEGYLSQVIHIISKMMVDYKAIVVLEDLNMGFMRGRQKIERQVYEKFEKMLIDKLCYYVDKQKEANADGGLLHALQLANKFESFRKLGKQSGCLFYIPAWNTSKIDPVTGFVNLLDTRYENAEKARCFFGKFDSIRYNAAKDWFEFALDYDKFTTKAEGTQTKWLLCTYGTRIDSFRNPQKQNQWDSEEINMTEAFKEAFAEAGIDIHGNLKDAICSLCDKKTSASLLKRFMHLMRLLVQLRNSETGTENDYILSPVADANGNFFDSRRADDTLPKDADANGAYNIARKGLWVVQQIKGCKEGEKPKLSISNKEWLKFVQQKPYLD

SEQ ID NO: 350 - protein, 1255 aa, unidentified
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHQNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLGGWDVNKEPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 351 - protein, 1245 aa, unidentified
MSLYDSFTGVYPVQKTLRFELIPVGETQEHIEKKGYLVTDEHRADSYKKVKKIIDRYHKDFIESVLGQIQLDGLEEYAKLYYEKQRNDQQEKQFDTIKKGLRKQISDAFKSFDQFKKMFGKEMIEDLLIKYTEDNPDDQKSVLEFESFSTYFQGFYENRKNMYSGEGKSTEVAYRIVDQNLPKYLDNIIIYEKAYQSGLGDKIEKTLKEVNKHYELESIEELFELKGFNSVLSQKGIDMYNCIIGGFSESDRVKVQGINETINLYNQQVNSKDNKKIPKCKSLFKQILSDRENISFIQDQFESDEEVVAAIYDFYDEMQTSLFENSDSLNIDELFSDIGNYNLEGVYIKNCQALTDISQHLYSDWSIINHALESNYDNNQSSKNKNTEKYIEKRKKELKKNKYYAIAFINQILSDYTKEDVAVEKYYSDLFVGEENYLKKITDQKKKLDEVVKSWKESGKSLNKNDEIIEAIKELLDLFKDLQRIIQPLINNDVSSKDFMFYNELERMWNNLDVLTSLYNKVRNYITRKPYSIEKYKLNFNRPTLLAGWDKSKERDCLGILLRKNDLYYLCIMDKNNSKVFMDVPRGNGDSCYEKMEYKQVKPLTDFAHVFFAKKNIKKYNPSEEILKIKKDESYIKNNDNFSLDNCHKLIDFYKECIKINEEYEIFNFKFSDTSSYNDISEFYKEADKYKYAIQFEYVDENYINQLVAEGKIYLFQIYNKDFSVYSKGNPNLHTLYWKMLFYPENLKNIVYKLNGQAEIFYRKSSINKEDIIRHPANIPINNKNELNTKKTSVFDYELIKDKRFTIDKYQFHVPITMNFGALGDNHFNRTVNTVIKNTDDVNVIGIDRGERNLLYLVVINSKGEIIKQKSLNEIINVGKNNIYHKTDYHKLLDYREKENKAARNNWKTINTIKELKEGYLSQVIHVITEWMVKYNAIVVLEDLNFGFKRGRQKFEKQVYQKFEKMLIDKLNYYVDKNADVQSPSGLLKALQLTNKFDSFSNMGKQSGFLYYVPAYLTSKIDPTTGFANLFNGSDLRYSSVETSKEFFNKFKSIIYNPNGINGKDYFEFTFDYLDFTYKAEGTQSVWTVCTFDKRIHHYRNSSKNNEWDTEEIDLTQSVKDLFNKFDVNMEEGNLKEKIINISDKSFYKDLLWLFSLTLQMRNSDADKNIDRLISPVLNEKGFFYDSDLKSDMLPYDADANGAYNIAKKGLWIINQIKSMDDDKVDKLKTISNKEWLQFAQENKL

SEQ ID NO: 352 - protein, 1231 aa, unidentified
MTKRDGFINQYSISKTLRFSLLPVGKTEEHFNHKLLLEKDKTRAQEYQKVKEYIDRYHKYYIESVLKKAVLSNVSEYAELYYKSAKTENDFKTMEKLETAMRKQIAGWLTKTDTYKLLDKREMIEEILPEFLKDADERATVEMFRGFATYFSGFYENRKNMYSAEPQSTAIAYRVVHENLPKFLDNAAAFAKVKNALPAETMDELNATYQGLYGVSVEDVFSVEYFSFVLAQSGIDRYNDILGGYTCEDQTKVKGLNEHINLYNQQVAGNDRSKRLPLMKALYKQILSERETVSFLPEQFASDNAALLAVKRFYEDVMDSSAQDAQTLFAELETFDPDGIFVRSGPAVNELSNAVFGSWSAVVGAWEEEYRLAHPLKGKADPEKYEEKMKKAYKAIASFSLAKVQALGAQSATDEHSDKTVVEYYKQAVAQALEDVKTAYEQAKGLLDSDYEATHVKKLCANDEAIDCVKTLLDAIKNVEHLLKSLRGSGKEESKDSVFYGRFTPLYETLSSIDRLYDKVRNYVTKKPYSKDKIKLNFDNPQLLGGWDRNKERDYRTILLRKNGMYYLAIMDKSNNKAFMSLPSTAGVEHYEKMEYKLLPGPNKMLPKVFFAASNIDTFAPSPEILAIRKNETFKKGDKFKLEDCHQFIDFFKASIERHEDWKQFGFRFSPTEKYRDISEFYNEVKEQGYSLRFQDVDAAYINGLVESGQLYLFQIYNKDFSPHSKGRPNLHTMYFKMLFDERNLKDVVFQLNGGAEMFYREASIRKEEQIVHPANQPIDNKNPNNPKTQSTFVYDLIKDRRFTKRQFALHLPITLNFKADGKSYLNEEVRAAVKNAEDTYVIGIDRGERHLLYICVINGKGEIVEQRSLNQILGEHGHKVDYHALLDKKEAERDAARKSWGTIENIKELKEGYLSIVVHEICQLMLKYDAIVALEDLNFGFKRGRFKVEKQVYQKFENMLIQKLNFLVDKTAEPTENGGVLRAYQLTNKVEGVHRGKQNGFLFYVPAWMTSKIDPTTGFVDLLKPRYTSVADAKGFISVIDVIRYNQGEDLLEFDVDLDKFPRCTADFRKRWTVCSNADRIETFRNPQKNNMYDNRRVVLTEEWKALFAQYGVPLSEDMKEAILGVKETEFYRRFMKLMGLTLQMRNSITGDSSVDYLTSPVRNRDGLFFDSRNYSDTAALPANADANGAYHIARKALQMIDVLKQTPEHELAKADLTISNADWLAYTQK

SEQ ID NO: 353 - protein, 1253 aa, unidentified
MKQFINLYPVSKTLRFELKPIGKTLENIEKGNLLKEDAQRAEDYKKVKCFIDEYHKQFIKSRLWNFELPLRDEGKNCSLEEYQALYELKKRNEKEESDFTEVKDRLRAIIVKQLTAKGSAYDRIFKKELIREDLLNFLQDESEKEIVRQFADFTTYFRGFYENRENLYSAEAKSTAIAYRLIHQNLPKFMDNIRTFSKIAQTSVSAHFDEIFTQWQDSLNVNSLEEFFSLNNFTRVLTQEHIEMYNYIIGKRILEDGTEIKGINEYVNLYNQNQKDRKNRLPFLVPLYKQILSDREKLTFLAEEFDTDEKMLEAVKETYASLYDKLMGDENESLRSLLMNIRDYDLSQIHICNNLSLTDISQRIFGKYDVFTKGIKEQLTFILPRKKKETDEKYEERLNKVFKSYKSFSIADLDQLPHPEIEEGRPHNLEEYFIQLGAIHSNSCQKENIFAQIENAYTVASPILQRIDTGGNLSQNKDAVSKIKNLLDALKDLQRFIKPLLGSGEESEKDGRFYGAFQVIWDELEIVTPLYNKVRNWLTKRPYSTEKIKLNFGNSQLLGGWDVNKEPDCTGIILCKEGEYYLGIINKKNNHIFERYDIALYGEGGEYFDKIEYKLLPGPNKMLPKVFFSKSREDEFAPSPSLIKKYKCGTHKKGANFSLDDCHALIDFFKQSISKHDDWSKFGFTFSDTLKYEDISGFYREVEKQGYHLSTRKISSFFVHQMVDEGKLYLFRIWNKDFSEYSKGTPNLHTLYWKMLFDERNLRDVVYKLNGQAEVFFRKSSISQENRTIHPAHMEIANKNAMAEKKTSLFDYDIVKDRRYTLDKFQFHVPITINFKAKGLNNINPLVIDTIREGGFSHIIGIDRGERHLLYLSLIDLNGRIVKQLTLNQIVNEYNGHQHPTDYRSLLVKREGDRTNARRSWDTIERIRELKEGYLSQVIYVITKMMVEYNAIVVLEDLNSGFIRGRQKIERQVYEKFEKMLIDKLNCYIDKKKDPESEGGMLYALQLANKFESFSKIGKQSGCIFYIPSWNTSKIDPVTGFVNLLDTRYESMKASKVFFSRFDRIIYNAQKDWFEFSFDYNNFHKKAEGTQTQWTVCSHGTRIHTFRNPMKNNQWDDEEIVLTEKYKALFEKYGIDYKENLKDAIQGSKEAKFYQELMALMKLLMQMRNSKTNTDIDYMLSPVSDKSGNFYDSRICGDSLPENADANGAYNIARKGLMLVRSIMATPKDKKPSLVITNKEWLYFAQTKPYLYD

SEQ ID NO: 354 - protein, 1211 aa, unidentified
MNTLKRFTRIYPLSKTLRFELKPVGKTMDNILTSGLIEQDQHRDESYRLVKKIIDEYHKAFIEDVLSNFKLHYEDDGKKDSLVEFYTYYMCKSKDEVHKSQFESIQKNLRKQIAGAFSVDDRFKRIDKEDLIKNDLLGFVKNVEDGKLIEEFRNFTTYFTGFHQNRKNMYSDEDKSTAIAYRLIHENLPRFIDNMMAFSKIAASPVAEQFKILYADFAEYLNVAEISEMFKLDYYNVVLTQKQIDVYNAILGGKTVEEDNVKIKGLNEYVNLYNQQLKDKAARLPKLKPLYKQILSDRNAISWLPEQFKNDENVLEAIQKAYQEVYDRVLYPNIEGEHSLKELLQALPNYDIDKIYIRNDLQMTDISQKVFGHWGVISKALLEELKRNVPKKSKKETDEVYEERLRKVIKSQGSISVAQINSSVHTLNNETSNNLQKYFANLGAVDSDASQNENLYTQIENAYLEVKDLLNTPYPEDCNLAQDKANLDKIKNLLESLKALQHFVKPLLGDGTEAEKDDKFYGEFTALWKELDKITPLYNMVRNYMTRKPYSTEKIKLNFENSTLLNGWDVNKEQDNTSVILRRNGLYYLAIMNKKHNKVFNVKNMPSVGECYEKMEYKFFKDLTTMVPKCTTQLKEVKNHFTTNSDPYILKKDVYTSEFIITRDEFELYNLLYSGKKKFQVDYLRKTGEEKGYKEALVKWIKFCLRFLSQYKSTLVYDISSFYSESKIHSYASVDEFYKEINLCLYNISFRHVSVDYIDALVEDGKIYLFQIYNKDFSPYSKGTPNLHTLYWKMLFDERNLANVVYKLNGDAEVFFRKSSVKYEHPTHPANQPIANKNILNDKKQSTFTYDLVKDKRYTVDKFQFHVPITLNFKSTGNDNINQSVNEYIKETQDLHIIGIDRGERHLLYLTVIDLKGNIKEQYSLNDIINEYNGNEYKTNYHDLLAKREKERLESRQSWQTIENIKDLKEGYLSQVIHKISELIIKYNAIVALEDLNTGFMRGRQKVESSVYQKFEKMLIDKLNYLADKKKQPEEIGGILNAYQLTNKFDSFQKMGKQSGFLYYVPAWNTSKIDPVTGFVNLLDTRYENREKAKLFFSKFDIVRYNDNKGWFEFDFDYSNFTTKAEGTRTQWTLTTSGKRIMTFRDEKQNSQWVSKEVDLTTEFKNFFADYGVDMGCNLKDEILQQDSSEFFKGLFGLLKLTLQMRNSITG

SEQ ID NO: 355 - protein, 1230 aa, unidentified
MLNSFTNLYSLSKTLRFQLIPIGKTEDTFQGKNLLAQDEERAKNYQLVKGYMDEFHKAFIQRILSKTVLLDLDAYAALYYTPNKSEKDKAAMEKMEAAFRKQIAKAFHADPIYKQLNKKEFVRELLPAFLASRHDKERQKIVEGFYQFTTYFTGFFQNRENMYSDEAKATSIANRCINENLPRFLDNAKSFEKVFAELPVSDITELNQTFEGLLGYSVDYVFRPDHFSFFLSQSGIDTYNSVLGGYTTSDGTKVQGINEKVNLFNQQLKKEDRNLRLPVLKPLYKQILSDRDSYSFVAEAFETDQAVLDSVQTFYAETVEETLHGVSALFGDLSSFDPAGIFVQNGLAFTDLSQQVFGSWDILPRAWNEKYESEHPIGKKNPETYFEVESKARKAIKSFSVAELQMLGNSSDCEQKGNIAQWLQVAAEERITAVRDAYAKAQALLMQPYKAEKKLALNVSAVESIKTLLDAVKALEWLLKPLCGSGKETNKDEVFYGKFLPLFDALAQIDRLYDRVRNYLTKKPYSKDKIKLNFENPQFLNGWDRNKETDYRCVLLRKDGKYYLAVMDKTAPKVFEATPEAQGEPCYEKIEYKLLPGPNKMLPKVFFANSNIAFFAPSDEILSIRQRESFKKGEAFSLRDCHAMIDFYKESIAKHPEWNQYGFRFRPTAEYSDIGAFYRDVKDQGYKIRFVKVPDSYINAKVEDGSLYLFQIYNKDFSPHSHGKSNLHTLYFKMLFDERNLADVVYKLNGEAEMFFRYPSISEKEKIVHHANQPIQNKNPDNAKATSTFTYDIVKDERFTKPMFSLHIPISMNFKSDDFALLNDRVRRAIREKGEQYIIGIDRGERNLIYVCVINGKGEIVEQLSLNEIVSDNDHRVNYHDLLDRKEKARDEARKSWSTVETIKELKEGYMSQVVHKLCELVVKYDAVIALEDLNSGFKNSRVKVEKQVYQKFEKALIDKLNYLVTSKDPADAEQPGGLLHAYQLTNKADKTAHGLQNGILFYVPAWLTSKIDPVTGFVDLLKPRYQSVHQAQDFFSRFTSVRYHAQEDLFAFTFDYANFPRCGADARRVWTVWTNGERIRTFRDKQSGQFVNETVQLTAAFRALFEKYGFNLEEDLLPQIVANNDAAFHRELMRLFALTLQMRNSETGNVNVDYLISPVKGVDGTFFDSRDYKGQTALLPADADANGAFNIARKALWATEQIRAAAEGEERDVKLAVSNSDWLAFAQGV

SEQ ID NO: 356 - protein, 1132 aa, unidentified
MQDQLRSQIVKAFNDREEFKELGKKELITDLLPKFLDDENNKELVEEFKTFTTYFTGFHENRKNMYSSEEKSTAIAYRLIHENLPKHLDNVSIFEKLKTSKVSEDFANISKDLKEELQGKGLEDFFMIESYIELLSQSQIDRYNALIGGKSLEKNKKIKGLNEYINLYNQKQKDSKDRLPKLKMLYKQILSDRGALSWLPETFSSDNELLEKIEECRREFTTNEDGKGSLLEKIKQLIISLDKYDVNKIYIRNDIQITNISQKVFGSYGIIYAGLRELLKKDVKQKKKENIEDYEERLEKLIKALDSIAISTIEEGVASLELENKSSIVDYFKQNIETLFVDIENNYSKVKDLLNIEYSKECNLKQDKENVEKIKNYLDSLKALQSYIKPLCGKGNEAEKDEKFYGDFTQLWDEFNKITQLYNMVRNYLTQKPYSEEKIKLNFQNSTLLKGWDLNKERDNTSVLLRKDGLYYLAIMNKNHNAVFDIKNTKDKNNGECYEKIEYKLLPGPNKMLPKVFLSTKGIAEFNPSNELLQNYQNETHKKGDKFKIEDCHALIDFFKISIEKHKDWKHFGFVFSDTKSYEDLSGFYREVEHQGYKITFRNIAVDYIESLVEEGKIYLFQIYNKDFSPHSKGTPNLHTLYWKMLFEGDNLSNVVYKLNGEAEVFFRKKSLPNDKPTHPANEPIEHKNKLSGDYKSVFPYDLIKDKRYTVDKYQFHVPITINFKSENIDNVNDRVNQYIRESKDLHIIGIDRGERHLLYISVVDLQGNIKYQTSLNVINNYDYHNKLTEREKERDEERKSWQTIEGIKDLKEGYLSQAIHKICNLMIEYNAIVVLEDLNFGFMRGRQKFEHSVYQKFEKMLIDKLNYLADKKKNPQEIGGLLKAYQLTNQFKSFKELGKQSGFLFYTQAWNTSKIDPVTGFVNLFDTRYTNKENARKFFSNFEDIRFNKEKNYFEFEFDYNNFTTKADQTRTKWTLCTFGERIETFRNSEKNSQWDNKTIDLTNSFKELFEKYGINYLDLKEQIVNQEKKEFFEELLHLLRLTLQMRNSISNTDVDYIISPIADEEGNFYLSSKCDESLPQDADANGAYNIARKGIMIVERIKASKKGDKLDLAISNKDWLKFAQNKHYRK

SEQ ID NO: 357 - protein, 1249 aa, unidentified
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHENRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDNSQLLGGWDVNKEPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFQFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 358 - protein, 1222 aa, unidentified
MKFENFINRYSLSKTLKFSLIPIGNTLKNFEAKKLLEEDEQRSVNCQKVKKYIDKYHKHCIEKVLAGYVPLKDLLEYAELYFSSDKGGDDLEAYEDSMRRQIAAFFAGSKVFASPKELIDNILPEFLTDEKEIETVRSFKGFSTYFTGFYDSRKNIYTPEAKANSIAFRCINENLPKFLDNVKSFRKIADGLSKEALDALDSEYEGLCGATLEDIFTVDYFGFVLSQSGIDRYNTVIGGYSTSDGGKIKGINEYVNLHNQVCGKEERLPQLKILYKQILSDTETLSFIPEKFKSDKEVLDAVNGYMTETLCLGGEENDVLKKIVFLFSNLEQYNRDGIYIKNDTALTSLSKRISGKWNMLKELWDEKYESSYTKNIKNRDTFEAERDKAYRVIRSFSLSEISNLCGVYDGELDIIPVEEYYAEKVAKLCGEIRFNYERAKSLFTAEYSEERTLARKENDVTRLKDLLDSVKDLEEFMKSLAGSGKESNKDEVFYGEYSLYFNTVREIDKLYDKVRNYVTQKPYSKEKIKLNFENFNFLGGWDRNKEKDYRSVLFRKGENVFLGIMDKENSKVFEEIPAAETDECCYEKMVYKLLPGPNKMLPKVFFSKKGLEAFTPSDEIMRIYKSETFKKGPKFSLEDCHTLIDFYKESIEKHPDWSQFEFKFKPTEEYANIGDFYRDVKEHGYKVSFVKISDDYINNLVDSGALYLFQIYNKDFSPYSKGAPNLHTLYFKMLFDEKNLENPVFQLNGGAEMFYRPASIKNPKITHPANVPIANKNPDNPKKESVFDYDLIKDKRFTKPQFSFHVPITLNFKAEGENFLNNKVRFELKNSEDNYIIGVERGERHLLYVCVINGAGEIVEQYSLNEIGNVNYHSLLDRKEKERDAARKNWSNIENIKELKDGYMSQAVHKICELVMKYNAVIAMEDLSGDFKRSRTKVEKQIYQKFEKALTDKLRFLVDKNFEPEANGGLLRAYQLTNKDEFANAKQDGIIFYIPPYFTSNIDPATGFVDFLRPKYGSIADSVDFFGRFDFIRYNSDADYFEFGVNYDNFPGADKDYRKNWVICTHGERVHIFRNPEKNNAWDSKKLFLTDEFKALFDEFKIDYAQDDIKNDIIHQISKEFFIRLTNLLSLTLQMRNTGIDTVDDFFISPVKSANGDFFDSRDSAMNKKLPANPAANGAYNIARKALWAIERLKEASDEEVTKTKISVSNVEWLEFVQKDRD

SEQ ID NO: 359 - protein, 1222 aa, unidentified
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHENRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFENPQFMVGWDKNKETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFSLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 360 - protein, 1293 aa, unidentified
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYDNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLKGWPDAQASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 361 - protein, 1224 aa, unidentified
MRKIDQFTNQYSISKTLQFKLIPVGKTAEHFDKSGILEQDEERAKLYQNVKKHIDEYHKHYIDKKLATIQTMDISAYAELYGKAGKTPEDKIALRECSKVLRKQIADALSKNPEGKTDPIFDKLFKKECITELVPEWLEDDDKIFEVEQFKKFTTYFIGFYDNRKNMYTAEEKATAIAFRCIHDNLPRFLDNIAAIKRIIAHLPEGTLERIARDLGDKISHIPREQFELSFFVRTLTQGGIDRYNYVIGGYAPEEEQNIKGINQYVNEYNQTHKDNRLPMLKPLYKQILSDRGSISFRPEPFKKDEEVLEDVLTYCQQLEEPMGKLEELFASLEQYDPNGIFVRNNAAVTELSKELLGFWGQLRENWNEAYDSAKSERDRKKANYADDRDKAWKKQDSISVSELERYTEGKSVVTYYKALISGLICAVREKYLAAHELLSSVPYVKEKKLAKNDEDIALLKNLLDSIKNLENALYGLRGSGTEAERDSRFYGEFILRMEVLEQIDRLYDKVRNYITKKPYSTDKIKLNFENPQLLAGWDKNKEKDYRTVLLRRDGFYYLAIMDKSYSKSFVNYPSGENSSWEKMEYKLLPGPNKMLPKVFFAKSNIEYYAPSKEIMRIYEKETFKKGKNFVVKDCHKLIEFYQNSIAKHPDWSGFGFSFRQPEQYADISEFYKDVADQGYRIDFRPISSEYIDRLVEEGKLYLFQIYSKDFSPHSKGTPNLHTLYFKMLFDERNLKDVVYQLNGGAELFYRHPSITEAEQIVHPAGLPIENRHPTKEHTHRTLPYDVIKDKRFTQRQFSLHLPIKMNFKADGKGHINLPVREAVRECENNYVIGIDRGERNLIYITVIDETGKIIEQFSCNTVRNGEYSTDYHALLNAREEERLEARQSWKTIEGIKELKEGYVSQIIHKICGLVEKYDALIAMEDLNSGFKNSRVKVEKQVYQKFEKMLIDKLNYMTDKKKAPEEKGGLLQAYQLAEKFESFRQMSRQNGFILYIPAWLTSKIDPTTGFVDLLKPKYFNVEKSREMIRKFRSICFNEAEDFFEITLDYHDFIGGGIDSVGLWTLCTHGERIRSYRDRNGQYQTEKVNLPDLWKKLFEEFSVDYRSVDFKEAILRQESREFFERFLYLLRLTLQMRNSNSEEDYLISPVRNSAGEFYDSRNYGTDGKLPADADANGAYHIALKALWAIRKIKEAEPDKVGSVKMSISNAEWLSFAQGTAAQRLR

SEQ ID NO: 362 - protein, 1284 aa, unidentified
MNTTCTNLFALSKTLRFELIPQGKTLDFIQEKGLITNDEQRADSYQKMKKTIDEFHKYFIDLALKNVRLSFLEDYLDLYKQSAEYKKEPIFKEKLKKVQDNLRKEIVQSFSKDEVKTIFSILDKKELITVELEKWFENKEKKDLHFDEKFKTFTTYFTGFHQNRKNMYSSEPNSTAIAFRLIHENLPKFLENAKAFERIKQVPELQLKIEKIYKDFELYLNVNSIEELFELNYFNDVLTQMGIDVYNNIIGGRTETDGKPKIQGLNEIINLYNQTKSKNERLPKLKQLYKQILSDSVSLSFLPDAFTDGNQVLKAIFDFYKINLLSFTIDGQTESKNLLELIQQLLANISSFETEKIYLKNDTNLTTISQQLFGDFSVFSSALNYWYETKVNPKFTIEYSKVNEKKRENMDKTKAVFTKQDYFSIAFLQEIISEYSLSLDKDDELITKITPTCVADYFKNHFVAKKENETDKTFGFIANITAKYQCIQGILENADNYEEELKQDQKLIDDIKLFLDTLLELLHFIKPLHLKSDSITEKDNAFYDVFENYYEALNLLTPLYNMVRNYVTQKPYSTKKIKLNFDNSSFLSGWSQDYSSKGGLIIKKDTNYYLLIVDKKLTDEEKNKLKKNPELNLAYRVVMDFQKPDNKNTPRLFIRSKGTNFSPAVAKYNLPINDIIDIYDNGKFKTEYRKKNYEDYKVSLVKMIDYFKEGFRKHESYKHYNFSWKPSNEYDDIAQFYNDVQSSCYQLHDEKINFDALLEMVSEGKLYLFQIYNKDFSPYSKGKPNMHTLYWNALFEEQNLKNVVYTLNGQAEIFFRKASIKHENIITHKANQSIKAKNPLTPDAKNSFEYDLIKDKRFTVDKFQFHVPITLNFKAIGGSIINQNVLEYLKKNPEVKIIGLDRGERHLVYLTLIDQEGNILKQESLNTITDAKISTPYHQLLDNKEKVLDLARKNWGTVENIKELKEGYISQVVHKIATMMVEENAIVVMEDLNFGFKRGRFKVEKQIYQKLEKMLIDKLNYLVLKDKQPTELGGLYNALQLTNKFESFQKMGKQSGFLFYVPAWNTSKIDPTTGFVNYFYTKYENVDKAKAFFDKFQSIRYNTKANYFEFEVKKYSDFNPKAEGTLQEWTVCSYGERIETKRLKDQNNNFVSTPINLTEKIEDFLGRNNIVYNDGTCIKSQIAEKDAKEFFERLLYWFKMTLQMRNSVTGSDEDYLISPVMNAKGEFYDSRKADDTLPKDADANGAYHIAKKGLMLLNKIEQADLSKKVDLSISNREWINFVQK

SEQ ID NO: 363 - protein, 1301 aa, unidentified
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYDNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDTPTLLNGWPDAQASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFQFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 364 - protein, 1193 aa, unidentified
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNTNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFETSTLLNGWDVNKERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFQFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 365 - protein, 1310 aa, unidentified
MLDNFSNKYPVTKTLRFELRPVGRTLEHIQTKGFIEADENLSESYKKMKKTIDVYHKDFISRALSAATLNNLPEFLDAHLQHKSHSDDSTKKQMIKLQDGMRKQITDVFTSNNFKSEFDSLFKKELLTKNLKEFVTKYNTKNKEELFFVDDFKSFTGYFLGFHENRKNIYSSDPKHSALAFRLVHENLPKFIENTNGLKAIKDDHPKLFDMLAKQVNHSLDFIFSSGFSIEDMLDVEFYDNILTQQGIDKYNQILGGVTLEGNPKKLQGLNELINLYNQKLPKISGVRKAPKLRPMYKQILSDRGSLSFLPERFADDGELYDAVNEYYLGHLLATPDNTVATTLLETLKEMTTRLSSYDLTKLYLKNDKALAHISNTLFSDYSVLSTALSHYYETYINPLYSELLDGAKTQKKAESLIKEKDSFLKGFHSISTIERAYREYVASIDGDSDLRAFGISKPIQHYFSQCFVNKPTDEDKAAVDLLQDINNKYTTIKGKLNSEIEAGTRELLQKGTEVANIKHFLDAIMNFIHFMKPLSVAGGDVEEGLDIDASFYNDFLPLYDDLTLFYPLYNKVRDYISQKPFSQEKFKLNFENTNLLDGWDANKEKDRLSLIFRRDGRYYLGVMDKAHKNAFKALPECKEALASCYQKMHYKLLPGPNKMLPKVFFAAKNIAYYNPSEELLSNYKKGTHKKGPDFNLKHCHALIDFFKQSLAKHEDWKCFNFKFSDTSTYEDLSFFYNEISNQGYKVEFIDVDASYMDDLVESGHLYLFEIYNKDFSEKSKGRPNLHTIYFKSLFTDENLANAVYKLNGEGEMFYRRASIKSENTITHKKGERVQAKNPNTPNASRVLDYEIIKDKRYTQDKFSFHIPITMNFKADGIGPGQFNNLVKSTIRDKAQDMHIIGIDRGERHLLYLTVVDMNGKLIHQESMNEIVSGEDRVTPYHTLLDNREKERGNARKNWGVIEGIKDLKKGFLSQVVHKVATLIYEYNAVVILEDLNFGFKRGRFKVEKQVYQNFEKALIEKLNYLVFKDREANEIGGARSALQLTSPFTSFRDLGKQTGFLFYVPAWNTSKIDPVTGFVDLLKPKYENLDKAKDFIGRFDAIYYNKDKDYFEFLFDYNNFHNRADGTRTHWTICSHGNKRFVYDKKANNNRGGQKLVDVNAELKALFDSYDIDYEKLAGSDLRPFIKTKADKPLYSTLMYLLRVLLAMRYSKADSQMGGVIEDFILSPVADQNGVFFDTRDYLPTDDGASIPGERLPQDSDANGAYHIALKGLWLIRQIQNHEKEDFKGLNLKITNKDWLNFVQEKPYQ

SEQ ID NO: 366 - protein, 1211 aa, unidentified
MEAFQALFNASPERKKEESYKKELEKVQDSLRKEIVKGFSTGEAKEIFANIDKKELITELLEQWIQQQKEDDLYFDDKFKNFTTYFGGFHENRKNMYSDKAQSTAIAYRLIHENLPKFLENIKIFEKIKAVPEVYETCQTLYKDIEEYLNITKIDEAFELEYYNEVLTQTQIDVYNLIIGGRTAEEGKRKIQGLNEYINLYNQKQEKNKRIPKLKLLYKQILSDRSSTSFIAESFTEDQEVLNAIEKYYKFYLLAFQAEGKDDTENVLEKVKELLANLKEYDLGKIYLRNDSKITTIAQKIFGNYGVFNTALEYYYATVVKPDFQKEYEKANQKRRDTLDKAQAQFVKLSYLSIELLQTAIDTYIATIDKEEESYKRYSPTCIVDYFKNNFKAEKKEDSDKEFGLVDNIKAKYSCIQGKLGTPYPKDIKLIQQKEDIFNIKVFLDSLMELVHFVKPLTLATDSVLEKDQSFYGQLEPWVQQLDLLIPLYNKIRNYTTQKPFSEEKYKLNFQNSTLLDGWDMNKEEANTSILFVKEGNYYLGIMDKNQNKIFRNIPKATSDNCFQKVNYKLLPGASKMLPKVFFSNKNIDYFNPNEDILRIRNHSTHTKSGTPQTGFDKFDFNTQDCHQMIDFFKESINRHPEWKNFGFEFSPTKNYESIDAFYREVEFQGYNISYIPIDESHIHQLVDEGKLYLFQIYNKDFSSYSKGKPNMHTMYWKALFDEENLKDVVYKLNGQAEVFFRKSSIKNPVVHKANEAVANKNLLAKKKESVFQYDLIKDKRYTLDKFHFHVPITINFKATGKEFINQDVMDFLHQNPDVNIIGLDRGERHLIYLTLINQKGEIILQESLNNITAENHLITTPYHELLNKKEMERDEARKSWGTIENIKELKEGYISQVVHKIAKLMVQYNAILVMEDLNFGFKRGRFKVEKQVYQKLEKMLIDKLNYLVFKDVKPSEPGGLYNALQLTNKFTSFKEMGKQSGFLFYVPAWNTSKIDPTTGFVNLFDTRYENLEKAKAFFSKFGDIRFNPAEKYFEFVVENYSAFNAKAEGTRQDWTVFSFGERIKTFRNPDANNQWDNKVIQLTEDWKALFEKYKIDYRTELKEQILQQTEAGFFKAALDLFKLTLQMRNSITNSEVDYLISPVKNMQGVFFDSRKADDTQPKDADANGAYHIAKKGLMWLEQIRQFDGADWKKLDLDKSNRAWLQFIQNK

SEQ ID NO: 367 - protein, 1318 aa, unidentified
MKNNNMLNFTNKYQLSKTLRFELKPIGKTKENIIAKNILKKDEERAESYQLMKKTIDGFHKHFIELAMQEVQKTKLSELEEFAELYNKSAEEKKKDDKFDDKFKKVQEALRKEIVKGFNSEKVKYYYSNIDKKILFTELLKNWIPNEKMITELSEWNAKTKEEKEHLVYLDKEFENFTTYFGGFHKNRENMYTDKEQSTAIAYRLIHENLPKFLDNINIYKKVKEIPVLREECKVLYKEIEEYLNVNSIDEVFELSYYNKTLTQKDIDVYNLIIGGRTLEEGKKKIQGLNEYINLYNQKQEKKNRIPKLKILYKQILSDRDSISWLPESFEDDNEKTASQKVLEAINLYYRDNLLCFQPKDKKDTENVLEETKKLLAGLSTSDLSKIYIRNDRAITDISQALFKDYGVIKDALKFQFIQSFTIGKNGLSKKQEEAIEKHLKQKYFSIAEIENALFTYQSETDALKELKENSHPVVDYFINHFKAKKKEETDKDFDLIANIDAKYSCIKGLLNTPYPKDKKLYQRSKGDNDIDNIKAFLDALMELLHFVKPLALSNDSTLEKDQNFYSHFEPYYEQLELLIPLYNKVRNFAAKKPYSTEKFKLNFDNATLLNGWDKNKETDNTSVILRKDGLYYLAIMPQDNKNVFKDSPDLKANENCFEKMDYKQMALPMGFGAFVRKCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTMYWKALFDSENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFENFSKIGKQSGFLFYVPAWNTSKIDPTTGFVNLFNTKYESVPKAQEFFKKFKSIKFNSAENYFEFAFDYNDFTTRAEGTKTDWIVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 368 - protein, 1231 aa, unidentified
MKKINQFINRYPLSKTLKFSLIPVGKTEENFNNALYLETDRERAEEYKKAKKLIDNYHRHFIEEVLSKLYIDEVKEYASLYYQNGKTDIEQDKMEAMEAKMRKVIAKAFSSHKNFNSLFNKDIIQKILPDYLQSEGEKATISMFHNFTTYFTGFQENRKNIYTDEAIPTAIPHRCINENLPKFLDNALSFEKVKQTMPEEFLKNIDEECLELNGIYAKDIFCVDYFSFVLSQSGIDKYNNIIGGYTTDAGVKVQGINEHINLYNQQIAKQEVGKKLPFMKMLYKQILSDKESISFIPESFENDNEVISAINEYFSGKTLNTLDGIKTLFSKFATYNMNGIFVKSGSAITDISNSVFGDWGTVVNGWNMEYEDEKPINKAKNIEKYIEERDKAYKKIASFSISKLSHLAEITSTKNVKGNIPQYYSEAVNEKTNKILENLKKSEKLLKEDYTVNNTIKLCKNDDAIHKIKTLLDSVKELERLLKSLLGSGKEEEKDDVFYGEFLPIYDCISSIDHLYDKIRNYITKKPYSSNKIKLNFDNPQLLGGWDKNKERDYRTVILRKSQKYYLAVMDKSDSKVFLEYPSGNANAYEKLEYKLLPGPNKMLPKVFFATSNLEYYKPSKEILDIRKKESFKKGDTFNLKDCHTFIDFFKDSISKHPDWSQFGFEFSPTKTYKDISIFYNEVKKQGYSIKFKPISEDYINTLVETGKIYLFEIYSKDFSEHSQGTPNLHTLYFKMLFDEKNLADVVYQLNGGAEMFYRDASIKDTEKIVHPANVPIKNKNLDKTKNVSIFTYDLIKDRRYTKRQFSLHIPITLNFKADGQTFINNDVRKAIKDSEKNYVIGIDRGERNLLYICVIDNDGNVVEQKSLNEIISPNGYKVDYHKLLDSKEKGREDARENWGTIENIKELKEGYLSQVVYEICHLVQKYDAIIAMEDLNFGFKKGRFKVEKQVYQKFENMLITKLNYLVNKNANPDENGGLLKAYQLTNKVDGVNKAKQNGFIFYVPAWLTSKIDPVTGFANLINPKYKSIKDSVEFINNINDIRYNALEDLFEFDIDYAKFPKACNSYRSKWTVCTNGERIISYRNKDKNNSWDNKTINLSAEFKRLFEKYNINYISSNIKDDILSQDSAEFYKQFMYFISVTLQMRNSETGSVDVDYLISPVKDKNGTFYDSRNYAIAGAPFPANADANGAYNIAKKALWAINVLKETPDDKLKNADLSIKNAEWLKYVQK

SEQ ID NO: 369 - protein, 1283 aa, unidentified
MSNMQQYDNFINHYAIQKTLRFELQPIGKTREHIQKNGIIEHDEALEQKYQIVKKIIDRFHRKHIDEALSLADFSKDTAMLKRFEELYWKKNKNENEKNEFVKIQSDLRKRVVSFLEGKVEGDARFAKVQQRYGILFDAKIFKDKEFISTACDDIEKDAIEAFKRFATYFTGFHENRKNMYSADEESTAIAYRVINENLPRFLENKARFEKIQHTVDSKTLNEIATELKPVLEKNKLETIFTLNYFQNTLSQAGITYYNTILGGKTKENGEKVQGLNEIINLFNQKNKDTMLPLLKPLYKQILSEEYSTSFTISAFEKDNDVLQAIGSFCNDCIFYAKNNVNGKAYNLLQTVQAFCNSIDTYNDNRLDGLHIERKNLATLSHQVYGEWNILRDALQIHYEAYEQKDNGNNNNYLESKTFSWKALKDALTTYKSLVEEAQDIDENGFIAYFKDMKFKEEIDGKTTSIDLIENIQTRYKSIETILQEDRNNKNNLHQEKEKVATIKGFLDSVKYLQWFLNLMYIASPVDDKDYDFYNELEMYHDTLLPLTTLYNKVRNYMTRKPYSVEKFKLTFEKSTLLDGWDKNKERANLGVILRKGNNYYLGIMNKKYNDIFDSIPGLTTTDYCEKMNYKLLPGPNKMLPKVFFSKKGVQFYKPSQEIIRLYNNKEFKKGDTFNKNSLHKLINFYKESIAKTEDWSVFQFKFKNTNDYADISQFYKDVERQGYKISFDKIDWEYILLLVDEGKLFLFKIYNKDFSPYSKGKPNLHTIYWKNIFSHDNLNNVVYKLNGEAEVFYRKKSIEYPEEILQKGHHVNELKDKFKYPIIKDKRYAEDKFLFHVPITMNFLSKGEPNINQRVQQYIASTSEDYHIIGIDRGERNLLYLSLIDATGKIIKQLSLNTIKNENFNTTIDYHAKLDEKEKKREEARKNWDVIENIKELKEGYLSQVVHQIAKLMVEYKAILVMEDLNTGFKRGRFKVEKQVYQKFEKMMIDKLNYLVLKDRQATQPGGSLKAYQLASSLESFKKLGKQCGMIFYVPAVYTSKIDPTTGFYNFLRVDVSTLNSAHSFFNRFNAIVYNNEQDYFEFHCTYKNFVSEPSLQKNVKSSKMHEYNNLKDTTWVLCSTHHERYKKFKNKSGYFEYKPVNVTQSLKQLFDEAGIDYQAGADLKEAIVTGKNTKLLKGLGEQLNILLAMRYNNGKHGNEEKDYIVSPVKNNYGKFFCTLDGDASLPVDADANGAYAIALKGLMLVERMKSNKDIKGRIDYFISNNEWFNYLIAKNTLNKSK

SEQ ID NO: 370 - protein, 1272 aa, unidentified
MSNFSDFTGLFSLSKTLRFELKPVGKTKENIEKNGIIERDNERAIAYKAVKKVIDEYHKAFIDQMLNNFKLDFEKLHEFYRQYNLNPNDASGKEKKKKAMAKVQDEMRKQISERFTKSEQYKRLFGKELIREDLAKFVKMPQYENVIREMPGNESLTDEAVKQIQENIQKDIAQFDDFTTYFVGFYDNRKNMYVADDKATSIAHRMIDENLPKFVDNMDVFERIAASEVASHFNEVYKAFELNVNAVGEMFQLDYFSIVLAQKQIDVYNAIIGELNKHTNLYNQHQQKDKSNKLPKLKPLFKQILSERNSISWLPDEFESDNEMLQSIRKCYQDLKEQVFDPLKTLLGNIKDFDLEHIYLPNDLQLTDIAQKHFGSWSVIRNAVVEDLKASNPQKRNEDAEEYEKRMTKLHDSYSIAYLNGIMQGKVEDFKPIEDYFVGMGAEDNDNGQKLNHFARIENAFTEIKTLLNTKYPEDKNLSQDKTNVEKIKNLLDAIKDLQHFVKPLLDCGTESEKDGRFYGEFTPLWETLDQITPLYNMVRNRMTKKLYSDEKIKLNFDTPTLLNGWPDAQANSGAILKDDKGLYYLAILDSMYRTCLNELESCPAERSEMAIMKYLQGGDMGKNVQNLMRIDGITRKVNGRKEKEGALVGQNVRLENAKNTYLPREINDIRLKQSYLTSSPSFNKKDLALYIEFYIHLVREYYSDYQFSFKNPSEYKSFVEFTDHINQQAYQVKFDPISKEQLFQLVDEGKIYLFQIYNKDFSPFSKGTPNMHTLYWKALFDEKNLADVVYKLNGEAEVFFRKHSLRADKPTHPANQAIANKNIQNKKKESTFAYDLIKDSRYMVDKFQLHVPITMNFKAAGINNINSLVNAYLKESNATHIIGIDRGERHLLYLSLIDMKGNIVEQYSLNEIVNEYNGNTYCTNYHDLLDAKEKQRDEARRSWQTIENIKDLKEGYMSQVVHKIAELMVKYNAIVVLEDLNIGFMRGRQKVEKQVYQKFEKMLIDKLNYLVDKKLDAGATGGVLNAYQLTNKFESFQKMGKQNGFLFYIPAWNTSKMDPTTGFVNLFNTRYENMEKAKAFFGKFDTIRLNSAKGWFEFAFDYDNFTTKAEGTQTKWTLCTYGTRIETKRNPEKNNEFDSVEFDLTERIKKLFAKYQIDVNGNIKEQICNQSDASFYREMLHLLHLTLQMRNSITGTDTDYLISPVQNAQGEFYDSCTCGNNLPKNADANGAYNIARKGLWVVEQIKHADDLTKIKLAISNKEWLRYAQGLD

SEQ ID NO: 371 - protein, 1238 aa, unidentified
MKKIDGFINKYPISKTLRFSLIPVGKTEENFNNACILENDKKRSVEYKKAKKIIDEYHKAFIERKLNEFSYDTKLNKLFIEQLRNYADLYFKNNKTDSEIKAMEESENNMRKYIGDVFSSDKEFKLLFAKEIVKDILPECLNNKEDLSTIEEFQNFFTYFRGFNENRKNIYTSEAHTTGVANRCINENLPKFLDNTSTYRKVIGALDPNDIKAINDLSAELFGVDIDIIFTVDYFVSVLSQGGIDRYNGIIGGYTKESGVKVKGLNECINLYNQIVIKIDKNKKLPLLKMLYKQILSDKESISFIPQSFENDEDVFDSIKECFGSLNETLKELSELFDRFGDYDLDHIYVGSGTAVTDISNAVFNDWSAVRQGWNAKYEKTHPLKDIKRSDKYFEQRDKEYKKSLSFSISDLQEFGESDNCKNLISDFYKDKVVTFVNDVQKKYNAYVEFISVTEDTSSKKLCFNYDAIKVIKELLDGVKELERIIKPLMGSGKEEIKDELFYGEFLPCINAFSTIDALYDKVRNYVTKKPYSTEKIKLNFDNPQLLAGWDKNKERDYRTVLLRKDNNYYLAIMDKSNNKIFLDPPECNSESFYQKIEYKLLPGPNKMLPKVFFAESNLDRFKPNSKIMSIREKESFKKGKNFNLKDCHEFIDFFKESIEKHEDWSQFGFEFSPTETYNDISEFYNEVKEQGYSIKIKNIPESYISEMVESGQLYLFRIYNKDFSDHSHGKPNLHTMYFKMLFDEENLKDVVYKLDGEAEMFYREPSINEDELTIHNANEKLANKNKLRKKEMSVFPYDIIKDRRYTKRQFSLHIPITLNFKADGKKSINDEVRKAVKDCGKNYVIGIDRGERNLLYVCVIDNNGDIVLQKSLNMITSSNDTTVDYHHLLSKIEEDRQDARKNWGAIQNIKELKEGYLSQVVHEIYKLVLKYDAIIAMEDLNFGFKKGRFNVEKQVYQKFENMLIEKLNYLVSKDADINENGGLLKAYQLTNKVEGVNKGKQNGFIFYVPAWLTSKIDPVTGFADLIKPKYSSKKDSLEFINKIDAIRYNCNPENEYFEFDIDLSKFPGTNASYKKEWTICTFGERIINYRNKDKNSAWDSKTIVLTTEFKNLFDRYNIDYMKNDLKESILNQSSEEFFKSFIALFANTLQLRNSETGNTDLDYLISPVKDKDGVFYDSRNYPEYCSRLPGNADANGAYNIARKALWAIEKIKETDDDKLKNVNLAITNAEWLEWVQK

SEQ ID NO: 372 - protein, 1287 aa, unidentified
MKTSNLSRFTNLYSLSKTLCFELQPVGKTKENIEKNGILIRDEKRAEDCKKVKELIDEYHKQYIKSRLWDFKLPLESEGKHDSLEEYKALYDISKRSETEEATFKEVKDNLRSVITQQLTSTPVYKRIKGKELIREDLIEFLEDEEDKEVVSQFADFTTYFSGFRKNRENMYDAGEKSTAIAYRLINQNLPKFIDNMKAFEKIAATPVAEHFVDIFVGWKEYLNVGSIEELFSLDYFSDTLTQPHIEVYNYVIGKKVLEDGSEIKGINEYVNLYNQQLKNKDHRLPLLVPLYKQILSDREKLSWLAEEFDSDEKMLAAINETYVHLHDLLMGEENDSLRSLLMHLKDFDLTKINITNDLSLTDISQHLFGRYDVFTGGIKEELRLAKPRTRQETDEQHEDRIAKIFKAHKSFSIARLNSLPQPVMDDGIPRRIEDYFMKLGAVNTETTQKENHFARIENAYEDAKAVLQMKKTDDTLSQNKSAVSKIKALLDALKDLQHFIRPLLGSGEENEKDELFYGSFQMMWDELESVTPLYNKVRNWLTRKPFSTEKIKLNFDNAQLLDGWDENKEIANASIILCKDGFYYLGIIRKDCRKLLGLPMPSDGECYDKIVYKFFKDITTMVPKCTTQKKDVVAHFTHSQEDYILFDKKTFDTPVTITKEIFDLNNVLYNGVKKFQIEYLRSTGDKAGYEHAVSTWKSFCMQFLKAYKSTSIYNLALVEQQISSYYDLSSFYDAVNLLLYNLSYRKVSVNYIDSLVDEGKLYLFRIWNKDFSEYSNGTPNLHTLYWKMLFDERNLADVVYKLNGQAEVFYRKSSIKPENRIIHPAHHPISNKNELNQKHESTFKYDIIKDRRYTVDKFQFHVPITINFKAKGQDNINPIVQDSIRHGGFTHIIGIDRGERHLLYLSLIDLQGNIVKQMTLHEIINEYKGNTYKTNYHDLLAKREGKRTEARRSWDTIENIKEIKEGYLSQVVHVISKMMVEYNAIVVLEDLNMGFMQSRQKFERQVYEKFEKMLIDKLNCYVDKQSDPTFEGGMLHALQLTNKFESFRKLGKQSGCLFYIPAWNTSKIDPVTGFVNLFDTRYDNMAKAKSFFGKFKSIRYNTQREWFEFAFDYNDFTTKAEETRTEWTLCTYGERILTFRNPDKNSQWDDKEIVLTQAFKQLFEKYDIDIHGNMKEDICTQNDAQFFKDLLSLMKLLLQMRNSKTNSEVDYLLSPVADEQGRFFDSRSGIATLPDNADANGAYNIARKGLWVIRKIQETAENEKLSLTISNREWLQFAQTKPYLND

SEQ ID NO: 373 - protein, 1279 aa, unidentified
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHENRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLDGWDENKETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 374 - protein, 1283 aa, unidentified
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHENRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVNLYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDNAQLLDGWDENKETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 375 - protein, 1277 aa, unidentified
MDTIEQFTGLYSLSKTLRFELKPIGKTQENIEKSGILKRDSQRAEDYKIVKRFIDEYHKWYIKNRLWSLRLPLKSEGRLDSLEEYQELYTLTKRNAEQEVNFTMVKDNLRSIIAKRLTDNSPAYKRIDKKELIREDLIEFLENEEDKELVRQFADFTTYFTGFHQNRLNMYTDEEKSTAIAYRLIHQNLPKFMDNMKAFAKIAETSVAEHFADIYEGWKEYLNVSSIKEIFQLDYFSETLTQPHIEVYNYIIGKKILADGTEIKGINEYVNLYNQQQKDKSQRLPFLVPLYKQILSDREKLSWMAEGFDSDEKMLSAINESYCHLHDMLMGEENESLRSILSHIKDYNLEQINITNDLSLTDISQHLFSRYDVFTNGIKDELRVITPKKKKESDEDFESRVSKIFKTQKSFSIAALNKLPQPVMEDSKPRYIEDYFMSLGAVNTEATQKENLFAQIENAYEDARAILQMKDTGDALSQNKPAVAKIKALLDAFKNLQHFIKPLLGSGEENEKDELFYGMFQLIWEELDTVTSLYDKVRNWLTRKPYSTEKIKLNFDSPTLLKNMAIPQTSSAAIFRDKRGYYYLGILDSNYRNCLNNLSLDIDSTSDSIEFMNYRQGGDMGKNVQNLMVINGVTRKVNGRKETSGEFVGQNLRLENSKNEYLPAHINAIRQKQSYLKTSATFNKEDLATFIAYYIPLVKEYYSDFVFHFKDPHEYTSFPDFTEHINAQAYQLFFTPISRKQVDQLVEDGKMFLFRIWNKDFSEYSKGTPNLHTLYWRMLFDKRNLSDVVYMLNGQGAEVFYRKASIKPENRIIHQAQCPIANKNELNEKRTSTFEYDIIKDRRYTVDKFQFHVPITIGFKAKGQKNINSNVQDTIRSGGFTHIIGIDRGERHLLYLSLIDLKGNIVKQMTLNDIINEYKGVTHKTNYHDLLAKREGERTDARRSWDTIETIKELKEGYLSQVVHIISKMMVEYNAIVVLEDLNMGFMRGRQKIERQVYEKFEKLLIDKLNCYIDKERDPSSVGGLLHPLQLTNKFESFRKLGKQCGCLFYIPAWNTSKIDPVTGFVNLFDTQYDTREKARLFFSKFQRISFNAEKGWFEFKFDYNDFTTKAEGTRTGWTLCTYGERIRTFRNPQKNNQWDDEKIVLTEEFKQLFGRYGIEIHGNIKEEIFAQSDAQFFRELLGLMKLLLQMRNSRTNSEEDYLLSPVEDEKGHFFDSRENIETLPNNADANGAYNIARKGLWVIRKIQETAENEKISLDISNKEWLQFAQTKPYLSD

SEQ ID NO: 376 - protein, 1264 aa, unidentified
MIRKSIYDEFINKYSLQKTIRFSLIPVNETLNYIEKNGIIGEDEDRAYEYIKLKKLCDRVHKEFIEDVLSNLKLDSLDIYEELYNIEKKTDSDKKKFEKIQVNLREQISKSFTKNKNYNDLFNKNMINKKLIELFKSEEENLNIIKNFSKFTTYLTGFHENRKNMYSKEEKGTAIAYRLINENLPKFIDNIKIFMKLKDTSIENEFLIISNELDKFLNGLKLQDVFKLENFNSVLTQEGIDNYNSIIGGYSRKNGEKIKGLNEYINLYNQITEKNKRIPKLKPLFKQILSDESSKSFIYKGLENDNEVLEVLKNLHESLEKEVINSSSGISILDLFNDIENYDLSKIYIKNDASITNLSQRIFGDWSLIKEGLILKYDDENKNVKSKKYEEDREKYINNRESFSIEELNRAIDYLEKENSEKIDDIYLSFKAKESEKNYIEEVYEKYNLLKDVLEKDYDNKKGLGKDTENIKLIKDYLDKLNEMKNFVKPLLGSGKEAEKDEKFYSELERIWKSFGFITAVYNKVRNYITKKPYITEKIKLNFKNPQLLAGWTANKEVDRSSIMFKDNNFYYLGIINTTYNSEFKEYKKPKNKEDVFLKMNYLQAGDPSKDIQNIMIIDGKIVKKNGKKSENGENLVLEELKNKYLPKEINRIRKTKSYSKSRESFNREDLNMFIEFYKEMAIGYYSNYNFKFYETEKYDNFKSFTDHINMQAYQINFIEVSKEHIYNLVSEGKLYLFKIYNKDFSEYSKGTPNLHTLYWEMLFDTKNLENVVYKLNGQAEIFFRKRSIPKDKIISHKKHIPIKNKNLNNNKRESVFDYDLIKDKRYTVDKFLFNVPITMNFSAEEVKNINSSVNLAIKKCDDIHIIGIDRGERNLIYISVIDSSGKIIKQKSFNIIESEYKGNKYKVDYHNLLENKESSRDNSRKNWQTIENIKEIKEGYLSQVIHEIIKLMIQYNAIVVLEDLNFGFKRGRQKFEISVYQKFEKMLIDKLNFLVDKKENPENFGGLLKAYQLTNKFESFKSLGKQSGFLYYVNAWNTSKIDPKTGFVSLLSIKYKNINDAREFINKFDDIRYNLKEKYFEFDIDYSKFNKQYEKTRRKWTLYSYGERIVKFRDKNINNKFNVKEIDIKEEFTKLFEEYDVDYKNKSIKESIQFINDKEFFERLLKLIRLMLQTRNTGVINNGDIEKDYIISPVKNEKGEFYKSNINDEFLPKDADANGAYNIARKGLIIVKRLRDTRDEDIKKVKLNISNEEWLRFAQGLDK

SEQ ID NO: 377 - protein, 1298 aa, unidentified
MKTITGNSMKHYDDFTNLYSLSKTLRFELKPVGKTAENIKNSHLISKDEKRATDYQIVKKAIDKFHKLHIEEALSLVNFKDSDIDGFIEEFETLYFKKDKEEKDRKGVEEYQKHLREFIVSSLQGKEGKKTVSATKKKQNSESLKRIKERYDILFSKDLFDNEEFISLSKEFGYDEIVQRFKGFSTYFTGFHENRKNMYSAGSESTAISFRIIHENLPKYLENKRNYPKIKEALGKAKISSLEKELKDVLGKTKLEELFTVDYFQHTLNQSGINSYNTILGGKPAREGERKIQGLNEIINLTRQQNPELKIPSLKILYKQILSDAEGSFRVEAFEKDMDLLESLQEYWDEIILGHRDILSGKKKNLIEAVGKLAKKINIFSKNKLDEIFIENKNLTNVSMQVFGEWGLLNKSIAELFDQLNKDKPKNKTLEKEREKFLKQDVFSLRQLEEAFTVFRNLNKEYERYAPNAIQKYLSDYKIKITENKKETWISLSEEIESAFKVIEPILKEDRKEEKNLHQDKKKVEKIKTFLDSLKHLQGFLKLLHLSEAMEEKNHEFYDEWESYYEAVSHLNSLYNKTRNYLTRKAYSEEKFKLNFESPTLLNGWDKNKEAANLAVILRKDELYYLGIMEKKNNRIFEGIPKPKEKAIYEKMIYKLLPGPNKMLPKVFFSEKGLNTYLPPKEILKLYEAGEFKKGEGFKVASLHRLIDFYKDAISRNEDWKTFGFKFSPTKQFEDISAFYKEVEEQGYKIEFEKIDSSYIDSLVEEGKLHLFQIYNKDFSPHSSGKPNLHTIYWRSLFDKENLKRVVYKLNGEAEVFYRPKSINYSKDILQKGHHAKELAGKFKYPIIKDKRFSEDKFQFHVPIKLNFSPKYSENINPLVNDFLQQSKDFHIIGIDRGERHLLYLSLINSKGEIIEQRSLNSILNEHSKKQIDYREKLDAKEMEREKARENWDVIENIKELKEGYLSLIVHQISKLMVEKKAILVMEDLNFGFKRGRFKVEKQVYQKFERMMIEKLNYLMFKDMKPAESGGSLNAFQLSNQFESFTKLGKQSGMIFYVPANHTSKIDPTTGFFNFLYPDVTSLDKGKEFFKKFDKIVYNSKKDYFEFHCRYGNFVSEPSGDKKKDDLAIYNKVKNKEWVICSNKEERFRSFKNNSGHIEYKQVDVNVELKKILQEEKIDYAHGHDLKESITSSDKPSFLKSFADQLKILLALRYNNGLKGSDERDFILSPVANNEGKFFHSEKTSKANPNNADANGAYNIALKGLLLIDKIKAQKGNKKMDLKISNLDWFEYAWSRNE

SEQ ID NO: 378 - protein, 1242 aa, unidentified
MTLNEFTRKYPQSKTLRFALIPIAETQKYIEARHVLDEDEALAESYKKMKKTIDEYHKSFIDECLSNVTLSNLESFYRLYTSSADERKEEKWKISFDAVKIALRKEIAASFTDNKKYKQLNKKELIQKELEGWIEKNAPDLYFDESFKSFTTYFTGFNTNRMNMYTAEKKSTAVAFRLINENLPIFINNMRVYEIIRPHLSSELETLKGELGEYLNRRALNDLFTLENYNNVLTQGGIDEYNLIIGGKKTDKSLFKGINVYINLYNQKNPKDKLPLMTMLRKQILSDRESVSFLPEAFDDADALLDAVNGFCRELTAEKDGKSVLAELKDVLSALRDGGLDDLYVKSDAITAISVAIFGDYSVIPRAVYGEDRSDDGESRGKRKDPSYILLAEVEKAVDAYVRKLDSDVYGVRANGDKLVSRYFAAGADDRTTAFVEAYKNADALLNAPREDGCKLGQKDRELLKALLDALLKLYHFIKPLYVPSDAEYKKNDAFYGAFDPLYGHLEPVTRLYDKVRNFATKKPYSTEKIKLNFSSSTLLNGWDTSKEKANLGLLFIKDGKYYLGIMDKKHNKSFENVKGSDGSDVYKKVQYKLLPNPHMSLPKNLIPTKNPKKHGASDEIISIKENKSFTKGEHFSISDCHKLIDFYKSAISKYEGWDVFDFSFSDTDTYADISAFYREVSEQGYKITYKNIDAKYIDSLVKEGELYLFEIYNKDFSPYSKGRPSLHTMYWRALFDEKNLADVVYKLNGEAEVFYRKKSIPKNVTHPKGQPIEKKNPNAKEKGETSLFDYDIIKDRRYTVDKFLFHVPITMNFKANGRSDINDEVCTYLKNNPGVNIIGIDRGERNLLYISMIDRSGRVVKDEKGRPIQYSLNTITGKYTDRSGKEIPFETPYHKILDEREEKRKAARENWGAIESIKELKAGYMSQAVSHIARFMVKYNAIVVMEDLNSGFKNTRKKVEKQVYQNFEKALIEKLNYLVLKDCGENEPGGLYNALQLTSRFESFEKLKKQCGFIFYVPAWNTSKIDPVTGFTDLLKPKYENIAKAKAFFSKFKSISYNADGDWFEFSFDYNDFTDKARGSRTEWTVCTHGDTRYRYDRSLNNSKGGVETRNVTKHLKALFDGNDIDWKRGDIKEEILNQNGARFFAELISDLRLVFALRYSSASVGRDFILSPVADENGVFFSSEAGADGLPADADANGAFNIARKGLWVLEQIDRAEGYGDWTTKISNAEWLRYVQTRFK

SEQ ID NO: 379 - protein, 1288 aa, unidentified
MKTQNGDVMKLNNYTNQYPVTKTLRFELKPVGETADYIEDFKSQYLKDVVEQDEQRAKDYKIIKEIIDDYHRHYIEEKLSEPFDKKTGELFITEEDFENAFSYYQRFRENSKDDKVKKEWLEEQTTLRKNLVKVFSDRKKRLFKKELITKEIPTWLKEKGEWEENKNVVENFNQFTTYFTGFHKNRENMYSYEEQSTAISFRLMNENLPKFFNSCIQFKNILEKYDDLVLQCEEALLQKMGVSKIADIFQPGYFIHLFTQSGIDNFLELLGGRTKENGEKIQGLNEIINLYRQKNAIKAKELPNFISLYKQILSDRETSSFIPDQFENDKELMGSLKTFIAEMAKADGLLSQLENTVKALKEANLKKTFVKGGVAITGISQAIYGEHNILKSAIYHHVETVIYPTPKSGKVSETLEDKRKKYVNNQDLFSIAELESMLSVYTQQLDDDNPEKETILKIKDPISSHFLNVIERVKNDTEIAFDSSIEEVLPLLTLENLSNGKAGQEQTQKIQTMLDAFLSLSHAVKPLHLVKGRKPIDVPDVDMGFYSDFSTSFESYEQTVIALYNKTRNHLTKKPFSTDKIKINFENPTLLDGWDFNRAKWNNANLLRKDGLYFLAIMHPKHNKIFDDYSENGKCFEKINYKQVSGINKMLPKVFFSKKGIETFNPPISILNLYKNGEHKKGDTFNLKSCHQLIDYFKANIDKYKVNPTDKYGWEVFDFNFSSTSSYHDISKFYNEVEKQMYKLWFTNISKSYINQCIDEGKLFLFQIYNKDFSPYSKGRPNLHTLYWKALFDSENLKNVVAKLNGQAEIFYRKHSIKKEDRTIHPANEYLQNKNENNTKKTSSFEYDIIKDRRYTLDKFQFHVPITLNFKAKGVSRFNDEINHELAKSNQTHVVGIDRGERHLLYYSVINPQGQIVEQGTLNTISTDQGYEVDYQQKLDDKEKARDKARKSWTTVENIKELKAGYLSHVVHKLALLIVKYNAIVCLEDLNFGFKRGRFKVEKQVYQKFEKALIDKLNFLVFKDAKTNEPGHVLNALQLTAPFDSFKKLGKQTGILYYVQASYTSKIDPVTGFVNFLYPKYESLSKSKTFFESMDEIKYNIDKDYFEFSFDYKKMTPTRELTGYKTYWTVCTFGKKRFKNIRNANGNWESIPVNVTDELKALLNNEGVEFKSSLDLRQSIASIKNTKFYRRLFKLLQVTLSLRHSKIGTDEDFILSPVADENGKFFNSKNATEEQPGDADANGAYHIALKGLWNIQQIKEWDGKSNLNLAMKNVEWFAFAQKKPFLKN

SEQ ID NO: 380 - protein, 1255 aa, unidentified
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQENRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLADGWDQNKEDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 381 - protein, 1260 aa, unidentified
MKKIDYFNNIYSVNKTLRTALVPVGETEQNFIAARLLEDDQERAKQYKEAKKLADRYHRDFIEEKLQHVELKSLDEYASLYMKSNRSAEDNNALNKAEELLRKEISMVFTSDERYSQLFKVDMIKIILPEYLQDEDEIAIIKSFEKFFAYFDGYNKNRANMYVPEAKTTSIANRCINDNLPKYLDNIKSYQKICKKLSDKVLEVGQGLKDILDIKLDVLFTVRGFNFALSQSGIERYNKVIGGYTTKDGKKIQGINEYVNLYNQTVDKRDRLPLLKPLYKQILSLSDKISFVPEKFESDQAVLDAICDLWSNCENDLSLAMAIKESADVVSQFDEFDMSGIYVKSGANVTNLSKSVFGNWNVVAEGWNCIYGENVPQGRNIEKYIEKREKAYKAIASFSLAELQQCGEKIVSEQKIAEYIKAECIRLNNMIAEKYSDVKQLLTMPYDAQKKLYKNDVAIEKIKVFLDSIKSYEHFIKMFIGTGKEEHKDNIFYGKILPLYAKISEIDKLYDKVRNYMTQRPYSTDKIKLNFENPQFIKGWDKGKEYERSAQLLRKDGKYYLLIMAGKNKEKIKTVYKAVCTEENYYEKMCYKQMAEPAKDIPNLMVINGKTVRKTGRREVIIQNGASIVVNRKLEEAKKKYLPRNIYEIYKKQSYLRSNENFSIEDLRQYIDYYKQRVIEYHKDNYVFEFKNSNEYSSYKEFTDHVNSQAYQITFIRVGTNQINALIASGDIYLFQIYNKDFSEKSHGTPNLHTLYFRMLFDEKNLKNVVYQLNGSAEMFYREASISEGEMIKHKANMPIDNKNANNPKKTSVFKYDIIKDKRFTRRQFLLHMPITLNFKAEGLNVINHKVREAICECTNNHIIGIDRGERNLLYISVIDEQGKIVKQLSLNEIINSYNGVEYKTDYHQLLDRKENERLTSRQSWKTIENIRELKEGYLSQVVHKICELVVEYDAIIAMEDLNTGFKNSRTKVEKQVYQKFEKMLIDKLSYMVDKKLPAEENGGLLRAHQLVNKPDGKSKGKQNGFIFYIPAWLTSKIDPTTGFVSLIKPKYTSIEAAKEFIGKFKFIQYNSKDDLFEFGINYSDFDGGIIDYQREWTICSYGERIRSFRSAEKNNKYDYDVVYLTESFKSLLNEYSIMSYENLKRDILQISEKAFFERFLKLLSLTLQMRNSVSRERDIDYMISPVRNNAGEFYDSRKYKDNRNNDWPQDADANGAYNIARKALYAVKNIKEAPVDEIDKVSLAITNKQWLAFAQGENV

SEQ ID NO: 382 - protein, 1287 aa, unidentified
MDYSKFTKKYSISKTLRFELRPVGETAEYIEDFKSQYLRDVVAQDEKRAEEYLKIKELIDDYHRDYIEDKLSNPVNPDTGEYWFSDELFDTAYKEFIAFKKDTKNEKLRQIWMSRQELFRKMLVKAFVDKKDLFSKELITRDLPAWLSQKGIWEEHKATVESFSKFTTYFSGFHENRKNMYSDEDQSTAIAYRLMNENLPKFFNNCEAYRKNKEKYPSLDFGVLDLDDKFKPIYFRSLFTQSAIDEYAELLGGKTEESREKSIGLNEKINLYRQKSGLIRRDISEFTMLYKQILSDRESHSFIPDAFESDKEMFTSLAQYIEKANRLTSKLNKTLQKLQSANTDKIYLVSTELTNISQSMFSSYGMIESALKSDMEQNVYPAPKNGKVSSVLEAKRKKYMEEKVFSLAFLEEKLKPYLLETEQEEKSILSHLLEALKNAKLDNKLDEKVKTVLPLLKLEALDKKRIVPNSSNPNGSEGFLQVQNIQKMLDAFMSLSHALRPLHLVKGRKVIDMPDADAGFYADFSVQYEEYSQITISLYNKVRDYLTKKPYSKDKVKINFEVPTLLNGWAVNKETANASILFEKDGLYYMGIMHPKHKHLFEYSKNIDDMKNGKKSKVKDELYTKIQGGKNNSYRKIVYKLLPGANKMLPKVFFANSRLEFFSPSQDILDIRNRASDSKNGKAQKGYTKVDFSLSDCHKMIDFYKKSIDKHPEWREFEFDFSVTNSYKDLSGFYREVESQGYKIEFHDIKTKYIDQCIEEGKLFLFQIYNKDFSPHSKGSPNLHTMYWRGLFESENLKNVVLKLNGDAEMFYRKHSMKRKDTVVHRANETIDNKNKNNPKKTSTFAYDIVKDRRYTKDKFIFHVPITLNFKALNTFRFNDTINKELSKSIDTCVIGIDRGERHLLYYTVVDSKGNIIEQDTLNEISTDQGYKVNYQQKLHDKEQERDKARKSWGSVENIKELKDGYLSHVVHKLANLIIKHNAIVCLEDLNSGFKRGRFKVEKQVYQKFEKRLIDKLNYLVFKDAKEGEAGHYLNAYQLTAPFESFQKLGKQTGILFYVNADYTSKIDPATGFMDFLKPKYENLGKAKTFFESLESFIYNVEKDYFEFTFDYKKVTNKSLGSYKTVWTACTYGDVRYQNKKDEQGIWQTNSINVTQELKELCDDAQIEYKDGKELKDILALEKDTKFYKTLFWIMRLTLTLRHSRTGTDDDFILSPIANSNGEFFDSRKAPKTLPKDADANGAYNIALKGLWNLQKIREHDWEAEKPKNLNLYMKNEEWFSFIQSRV

SEQ ID NO: 383 - protein, 1253 aa, unidentified
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQENRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLADGWDQNNEAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 384 - protein, 1280 aa, unidentified
MNNFTNLYPVDLTLRNSLIPIGETLKNMTMHSYIEHDEQRAEAYKLVKGFIDDYHRAFIDSRLASFEFRIESHGTLDSIEEFTTLYNIKRDEKRDKEFTTVKQNLRKAISQRLTKCDAFARINKRELIREDLPYFIDSLDISEEEKVEKKKLVEQFAKFATYFSNFHTNRANMYVADEKSTSIAYRLINQNLPVFLDNMKVFAMLKALGFEDALSVIYSDMKEKLNVLSLDELFQQDYYSMLLTQRQITVYNEVIGGRSTKDGEKIKGLNEYINQHNQEHPTARIPFLRPLFKQILSDRVSMSWLPDSFINDEEMIRAINIFHQNIHPLLWGPMEDAGEPLKNILSQIDTFDTEHIFIINDSALTNISQRLFGQYNVITDALLSRLSQEMPRKRGRKPESDEAYNERLRKTFKAIKSFSISEINESLKSYMDEGTYIDISSYFLAMDERNDEYIQQANMFIRIENAYTEAKPFLNELRASNSSYNQDDDAIKYIKVLLDAYKSLQRFINPLVGSGEESSKDDMFYGEFMPIVEELKNLTPLYNKVRNWLTRKPYSDEKFKVNFDNSSFLSGWPQDYETKGGYIVEHNGLYYLFINEVKLDEAQVKFLCDHPDADNATRILLDFQKPDNKNIPRLFIRSKGENFAPAVEKYALPIASVLDIYDQGKFKTEYRSVNPDDYYRSLHKLIDYFKLGFTRHESYKHYSFQWKPTNEYKDISQFYHDVEVSCYQLKRVPINWNHLQELVIQGSVYLFQIYNKDFSTRSKGKGTPNLHTLYWRMLFDERNTKDLVYKLNGQAEIFFRRASIKPENQVIHQANQPIENKNPLRKAIKPNSTFSYKITKNRRFTLDHFEFHAPITMNFKAPGITNINPLVIDKIRKSEITHVIGIDRGERHLLYLSLIDLKGNIIKQMTLNTITDKWAGGEIAIDYQALLDQKEGDRLEARRNWKTIENIKELKEGYLSQAIHLIAQLIVENKAILVLEDLNTHFMHGRQKVEKQVYQQFEKQLITKLNYYVDKKKDADTAGGLLHALQLTNKFESFEKLGKQSGFLFYVPAWNTSKIDPVTGFVNLLNLHYETREKASLFFSKFKCISFNTEKNWFEFVMDYNEFTKKADGTRTNWTLCTFGERIETFRNPQANLQWDNRTINLTQAFNDLFQDYGIDIYGNLKNQICSQQKAKFFEQLLHLMKLMLQMRNSKKNSTSAEDDYILSPVADDNGVFYDSRSCSESLPRDADANGAYNIARKGLWIIKKIQASSADERLNLTITNKEWLNFVQTKQYLND

SEQ ID NO: 385 - protein, 1228 aa, unidentified
MENLKKFTNLYSKPITLRFSAEPIGNTGKNFRDNILQKDKDLDESYQEAKLIIDNYHRWHIDTVLKRTNLDENKLLEFYAIYTDKRYKDRDKLLASLQKGFRKVLSDSLLHNEKDLFGEKLITSLIPQWLELCGNKEALEVISKFNKFTTYFTGFNTNRKNIYTEEEKKNSITYRLIHENLLKFIDNINLFERIKETEVANNFDTIKNEAKLNIQLEEVFTITYFNKLLTQSGIDLFNLIIGGYSTEKRVKYKGLNEYINEYNQTHAGNQLPKFRPLFKQILSEKDSTSYIDKQFADSKDVIIAINQSYDAINTYVLPHLTQVLSLITPEKLSLIYIENGADITRISNELCGNYDFIKQHFIKEFELQRPRTSKETIEKYYEKINKAWSKDKFVTLEYINTILRQNNKEDIISYFTKERLATTLKKIEEAYKKFQSILTVDYNGELKSDKESVSLIKDLLDSIKDLQLFIKPLSKGEFETQKDNNFYNEFIPIYSVLNDNISHLYDRVRNYVTQKPYSTEKIKLNFENSTLMSGWDVNKEPDNTTIILRKDGFYYIGIMDKKSNKCFSSKNLPSEGECYEKMEYKLLPGANKMLPKVFFSKSRIEEFAPNPQLLRAYEKGTHKKGVGFRIEDCRNLIDFFKISIEKHNDWKQFNFRFSPTNSYQDISDFYREVEHQGYKITFRNISQSYIDALVAEGKLYLFRLYNKDFSQYSKGQPNLHTMYWKMLFDEDNLANVMYALNGGAELFFRPASLERKITHPANEPIACKSVENKGKASTFKYDLIKDKRYTQDTFQFHVPITLNFKGRGINTPKGFNEHINKYYLPHATHIIGIDRGERNLLYISVIDMNGRIVEQFSLNDIVNEYNGKQYHTDYHHKLDDREKARAKARESWQSIENVKELKEGYLSQVVHKIVQLVLKYNAIIVMEDLEKAFKNNRLKIEKSVYQKFEDALINKLSYIVDKTAGKENVCGLLNALQLAYIPQKKNDIINQCGIIFYIPAWCTSKIDPVTGFINKIDTRYTSIEKAKELIGKFADICYDDENECFEFKIEDYTKLGGIDDTRKDWVLTSRGMRIETVLNPTTQKYSEQVEINLTDEFMKLLQGGIGTNLKDYILHQDNSKFFKDLLRCIKLMLQMRNSKIGTDIDYLISPVKQDNGEFYSSKEEKQKGTDSCGQWKSTLPIDADANGAYNIARKGLMVANKLKSGSIPKEAFAVSNKDWLNFVQQNNV

SEQ ID NO: 386 - protein, 1280 aa, unidentified
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHTNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLSGWPQDYETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 387 - protein, 1093 aa, unidentified
MKQFTNLYQLSKTLRFELKPIGKTKENIEKNGILERDNQRDIAYKAVKKVIDEYHKAFIEMMLDDFELKQDLLEKFYLLYYLPTSDPNRKNDLPKVQEAIRKQISERFTKCEQYKRLLGSEKEKLIKEDLDEFVNNACTIRRIPGNEQLTDDEVQKEQERLLKYIDLFKNFTTYFENFHKNRENMYVANDKSTSIANRLINENLPKFVDNMDVFAKIAASDVAEKFNTLYKEMEEYLNVNDIREMFQLDYFSMVLTQKQIDVYNAIIGGKTLADGTKIKGLNEYVNLYNQQQKKKEDRLPKLKPLFKQILSERNAISWLPEEFKDDNEMLQSIGKCYQDLNTLVFGKLKTLLETLNDFDLDNIYLPNDLQLTDIAQKHYGSWAVINKAIEEDLKTVNPQKKRESEEKYEERIAKLLKANDSYSIGYINNLLKGKMEDFKPLEAYFSNIGAEDDGKEQKLNHFVRIKNAYTEAKSLLTAEYPDDKKLSQDKANVEKIKNLLDAIKDLQRFVKPLLGCGTESDKDSQFYGDFTPLWETLDQITPLYNMVRNRMTQKAYSVEKIKINFDNSTLLAGWDLNKEADNTCTLLRKDSLYYLVIMDKSNSRVLKAENLRSDGDCYEKMEYKQIALPMGVGAFVRKCYGTAQSYGWRCPKNCLNDEGKIIIKDDEAQPNLRCIIDCYKDFFDKYEKDGFKYKDFNFSFLESDKYEKLSEFFKEVEPQGYLIRFRNVSVDYINQLVDEGKIYLFQIYNKDFSLFSKGTPNMHTLYWKMLFDERNLADVVYKLNGEAEVFFRKKSVKVERPTHPANQPIANKNAQNNKKESTFAYDLIKDRRYTVDKFQFHVPITMNFKAAGLSNINPLVNEYLKKSNTTHIIGIDRGERHLLYLSLIDLKGNIVEQYSLNEIGNIYPTNYRDLLDAKEKQRDEARRSWQAIENIKELKEGYMSQVIHKIAQLMLKYNAIVVLEDLNFGFMRGRQKVEKQVYQKFEKMLIDKLNYLVDKKRDANELGGVLNALQLTNKFESFQKLGKQSGFLFYIPAWNTSKMDPTTGFVNLLDTRYENMEKAKAFFGKFDSIRYNAQKDWFEFAFDYNKFHN

SEQ ID NO: 388 - protein, 1221 aa, unidentified
MLEGFVNQYQLSKTLRFELKPIGKTLEYIGQKGLIEEDEERAEKYKLVKEIIDKYHKAFIEDSLHDLNLNGLDEYQEQFNTTSRDEKVFKKIQDTLRKQVADTFKKHPAWKTLFKKELIKSDLANWSELDANEKATVKEFEQFTTYFTGFHDNRKNMYSYEDKHTAIAFRVIHENLPIFLTNQKLFKTIKEKYPELINQTQKSLQDHLEGAVVEDMFELRYFNFTLSQTHIDLYNQMIGGIKKDDIKIQGFNEKINLYRQQNGLTKRDLPNLKILHKQILSDRDTLSWLPEKFESMDELVGSIDEFYINSVLEFECCDGKSNLLDKIPELFTQSDLYDFSKIYIRNDRSLTDISQAVFKDIDKSRAYSLIKEALWEVNKPKKSKDIASDEEKFFNKKNSYFSVAQIHEALQSARLQVDIFEYFINDNAKKLLVNIQTTYKAWQQNKTDKEKIKAFLDAVVEWLHLYKPLNAPNDMDKDIAFYSLFDSYYESIKAVIKLYDKVRNFMTKKPYSLEKFKFNFQSGYLLNGWSPDYDTRAGLLFEKDGNYYLGINIKKLTEVEKEYLFDNPNENLSRRIILDFQKPDNKNIPRLFIRSKGSNFAPAVAKYNLPIQSVIEIYDNGKFKTEYRKKNPKDYIDSLHKLIDYFKQGFLQHESYKHYKFGWKETKDYLDIAQFYQNVETSCYEVKSEDVNWNKLINYVNEGKLYLFQIYNKDFSSYSKGTPNMHTLYWRALFDELNLADVVYKLNGQAEIFYRKSKYEDRVIVHKANEPIKNKNPLNDKKESTFKYDITKNRRFLFDKLQLHIPITLNFKAEGNENITPKTLEFIQSNADDIKIIGIDRGERHLLYLSLIDDDGKIIEQYSLNEIMNEHNGTKYATNYHKLLDDKETERANARVNWGVVENIKELKEGYMSHVIHKIATLILEHNAIVVLEDLNFGFKRGRFKVEKQVYQKFEKMLIDKLNYLVDKKREANKLGGVFNALQLTNKFQNFEKMGKQNGFLFYVPAWNTSKIDPVTGFVNLFDTRYTSVEKAKEFFEKFKSIRYNQAKDYFEFEVDNYTAFNPKAEGTRQDWTICTYGERIKTFRNKEKNNQWDSKTVHLTTEFKNLFGNYENDLKSFILAHEEKSFFEQLLYLFRLTLQMRNSVTGTEIDYMISPVADKEGNFYDSRKADESLPKDADANGAYNIARKGLMLVERIKNTNNLKEIDMIITNKDWLQFAQK

SEQ ID NO: 389 - protein, 1308 aa, unidentified
MEKTIDEFCGQGNGYSRSITLRNKLIPIGKTADNLKQFLEKDQERADVYPEIKKLIDEIHRGFIEDTLTNFSFVWEPLFGDFELYQNEKDKTKKATKKKDLEKFQSGARKKIVEAFKKHPDYDKLFKDGLFKELLPALIENSSDTEISNKEEALKVFDRFSTYFVGFHENRKNMYSEEEKSTAISYRIVNENFPKFYANVKLYNYIKENFPQIISETEESLKNHLNGKKLDEIFNVESFNDVLAQSGIDFYNTVIGGISTETEKVQGLNEKINLARQQVISQISFLKNQNASENTEKIKELEKKANELKKKMVVLFKQILSDRGTSSFIPVGFNNNDEVYSSIKSFNDEFVNLSICETKELFKQVAEFNLSEIYVPAKSLTNFSQNIFGSWSILTEGLFLLEKDKVKKALSENQEEKINKEISKKDYSFDELQVAYERYCNEHNFSVEKNCKDYFDVVDYRSENEKSDKKKVSILSAITESYSKIDFENIHDLQQEKEAATPIKTYLDEVQNLYHHLKLVDYRGEEQKDSNFYSKLDEIITQLSEIIPLYNKVRNFVTKKPGEMKKIKLNFDCPTLANGWDENKESSNDAIILRKDGKYYLGIFNPNNKPKFSKIENISESYYEKMVYKLLPGPNKMLPKVFFSTKGQETFLPPKDLLLGYDAGKHKKGDAFDKEFMYKLIDWFKDAINRHEDWKKFNFVFSPTKSYEDMSGFYREVELQGYKVSFQKISDTEINSFISDGKLFLFQIYNKDFASKSSGKKNLHTLYWENLFSEENLKDVCLKLNGEAELFWRKPSLNKNKVTVHEKGSTLVNRTTNDGKSIPEDIYQEIYQFKNKMIDNLSENAKSLLDSGVVVCKEATHDIIKDNRFTEDTYLFHCPITMNFKAPDKSNKEFNNQVLDVLSDNPNVKIIGLDRGERHLIYLSLINQKGEIELQKTLNLVDQVRNDKTVKVNYQEKLVHKEGDRDKARKNWQTIGNIKELKEGYLSNIVHEIAKMMVEHNAIVVMEDLNFGFKRGRFAVERQIYQKFENMLIEKLNYLVFKDKKVTEPGGVLNAYQLTNKSANVSDVYKQCGWLFYIPAAYTSKIDPKTGFANLFITKGLTNVEKKKEFFDKFDSIRYDLKEDCFVFGFDYGKICDNADFKKKWEVYTKGERLVYNNTERKNISINPTEELKSIFDVFGINWNNEENFIDSVHTIQAEKSNVKFFDTLLRMFNATLQMRNSIPNTEIDYLISPVKSEDGTFFDSREELKKGENAKLPIDADANGAYHIALKGLYLLENDFNRNDKGVIQNISNADWFKFVQEKNYEK

SEQ ID NO: 390 - protein, 1307 aa, unidentified
MATIENFCGQENGYSRSITLRNKLIPIGKTANNLKQFLEKDQERADVYPEIKKLIDEIHRGFIEDTLSKFSFVWEPLFDDFELYQNEKDKSKKATKKKDLEKFQSGARKKIVEAFKKHPDYDKLFKDGLFKELLPALIKNSSDSEISNKEEALKVFDRFSTYFVGFHENRKNMYSEEDKSTAISYRIVNENFPKFYANVKLYNYIKENFPKIISETEESLKNHLNGKRLDEIFNAESFNDVLAQSGIDFYNTVIGGISTETEKVQGLNEKINLARQKLPAEEKNKLRGKMVVLFKQILSDRGTSSFIPVGFNNKEEVYSSVKSFNDEFVNISVCETKELFKQVAEFNLSEIYVPAKSLTNFSQNIFGSWSILTEGLFLLEKDKVKKALSENKEEKINKEIAKKDYSLDELQVAYERYCNEHNFSVEKNCKDYFDVVDYRSENEKSDKKKISILSAITESYSKIDFENIHDLQQEKEAATPIKTYLDEVQNLYHHLKLVDYRGEEQKDSNFYSKLDEIITQLSEIIPLYNKVRNFVTKKPGEMKKIKLNFDCPTLANGWDENKESSNDAIILRKDGKYYLGIFNPNNKPKFSKIENISESYYEKMVYKLLPGPNKMLPKVFFSTKGQETFLPPKDLLLGYDAGKHKKGDAFDKEFMYKLIDWFKDAINRHEDWKKFNFVFSPTKSYEDMSGFYREVELQGYKVSFQKISDTEINSFVSNGKLFLFQIYNKDFALKASGKKNLHTLYWENLFSEENLKDVCLKLNGEAELFWRKPSLNKEKVTVHEKGSILVNRTTNDGKSIPEDIYQEIYQFKNKMKDKISDNISIQNDDGKVITITVTLENKQKEKFTENYKVVYKTATHYITKDNRFTEDTYLFHCPITMNFKAPDKSNKEFNNHVLEVLSGNPNVKIIGLDRGERHLIYLSLINQKGEIELQKTLNLVEQVRNDKTVKVNYQEKLVHKEDDRDKARKSWQTIGNIKELKEGYLSNVVHEIAKMMVEHNAIVVMEDLNFGFKRGRFAVERQIYQKFENMLIEKLNYLVFKDKKVTEPGGVLNAYQLTNKSANVSDVYRQCGWLFYIPAAYTSKIDPKTGFANLFITKGLTNVEKKKEFFDKLDSIRYDSKEDCFVFGFDYGKICDNADFKKKWEVYTKGERLVYNKTERKNININPTEELKSIFDDFGINWNNEENFIDSVHTIQAEKSNAKFFDTLLRMFNATLQMRNSIPNTEIDYLISPVKSEDGTFFDSREELKKGENAKLPIDADANGAYHIALKGLYLLENDFNRNDKGVIQNISNADWFKFVQEKEYRD

SEQ ID NO: 391 - protein, 1131 aa, unidentified
MKSKDRNDDAALVLKFKGFTTYFGGFNENRRNMYSAEEKATAIAYRIVHENLPKFISNMKTFQRLSENHQIDFSEVETQMKDELDGNKLQDVFSLAYFNHCLTQSGIDRYNAVLGGKTNKKGNKIQGINEKINLFRQKKNLKSKDAPVLAPLYKQILSDRVSTSFLPENFETAKELIKSIWEFYKEGINGFIKNNEKKNVINEIESLFSRKLNPTDCDLSQIYIRNAFITAVSQQIFGSYSVITSALNAFIDKTYNTKKEKEKQQKKSYFSIAEIEAALKAYLQETEIENKEKREEFLKQANPILQYFNSLSISIELNDKKEKANVVTHFRQKHEAVQSVLNKAYESNNELIQDKKTVAVIKDYLDSYLHILRFVKPFFVAPPERKGAEMPDKDAFYSEFDEMFEELKSVTPLYNKVRDFLTQKPYSTEKIKLNFENVSLLSGWDVNKETDNTSVIFRKDSLYYLGIMNKKDNKVFHDIPASSDNDFYEKMNYKLLPGANKMLPKVIFSDRWIEYFNPSKELIEKYEKGSHKKGEIFSLSDCHALIDFFKTSIKKHEDWKQFGFQFSPTETYQDISGFYREVEHQGYKISFQNISAKYIHQLVSDGKLFLFKIYNKDFSPHSKGKPNLHTLYWKAAFDDANLKDVVFKLNGEAEVFYRPQSILEKSKVVHGKNKPIDNKNPNNTKKQSRFEYEIVKDKRYTKDKYHFHVPITLNFKSGDIFKFNDLVNETLKENFPNINIIGIDRGERHLVYYSLINSKGEILKQDSFNIVKNEYNGTKYETDYQASLVEKEKARDAARKSWDAIGKIKELKEGYLSQVVHKIARMMIEHNAIVVLEDLNFGFKRGRMKVERQVYQKLEKMLIDKLNYLVFKDREAAAPGGVLNAYQLAAPFTSFKDMGKQTGFIFYVPAANTSKIDFATGFVNLLYPKYENEKQAKEFFGKFETIRYNPDKKYFEFVAKYNNFVADEKAKLENDREWTICTYGKERYQYQPATKTYNPIDVTKCLQGLMDREQHKIHYDQGNDLKNNILSINNAQFFKDLIFYLRLVLQMRYTDGKGRDFILSPVANNEGVFFNSENAKENEPKDADANGAYHIALKGLLQLQKIRTGEKKLAISNKEWHDFVQERNNKK

SEQ ID NO: 392 - protein, 1215 aa, unidentified
MKINGFIHQYPLSKTLRFKLIPYGRTLEHFTTNISLQKDEELARLYQRVKGYIDEYHRHFINEVLSSVAALDVSAYASLYYKASKDPNDKKKLENEGNALRKKIATHFSSHKNYKTLFDKDLICNILPAWVEDEEKKREIEHFHQFTTYFVGFYENRKNFYTEEAKATGIANRCINDNLPKFLDNARSYEKLTQNFSAGDLSALLADVSGLTPTPIEEFFSLDGYKNFLSQNGIESYNHIIGAVNSHVNQFNQTHGKSEFVPKFKVLFKQILCEGKHFFAIPEAFTSDNEVLGAVNDHYTTVISSIERLNDLFCGIEGYNSSGIYLRNNTAVSELSYRITGSWHSIKDAWEKEYDNSIPNKKKRNDTFYENQEKTWKNISAFSLSALQGYTGDQTLPITDYLKKRSGILFGYILDCYRKAEDLIGKPYTNKSKRLAKNDDDIALIKNLLDALKAFELFAKPFSVSADAGDKDDRFYAVFDECYNDLSDLDRLYDKVRNYITQKPYSTDKIKLNFDNSQFLNGWDKNKEKDYRNVLLRKGNDYYLGIMAKDSSRLFLTYPNEDSNGWEKIEYKYISKPFMDLPKNAFSEKYRELMNPSKEILDIRSEKTYIKDNNNISNFSLSDCHKMIEYYQNFIALYPNWVEFNLHFKSPHEYNDINEFFTDVADQGYKLSFNPISEAFIEDHVASGELYLFRIYSKDFSENSKGTPNLHTLYFKMLFDERNLNDVVIQLCGGAEMFYRYPSIKPEELIVHHKGEPIKNKNSHNTKEFSTFEYDIIKDRRYSQPQFSLHIPIKLNYKSTGKDRINAAVRKALKASDKNYVIGIDRGERHLIYVTVVDNDGNIVEQFSGNCITNEYNDCVHTTDYRELLDRKEKERLSARQNWTTIEGIKELKEGYGSQIVHKICQLVVKYDAIIAMEDLNSGFKNSRAKVEKQMYQKFEKMLIDKLNYLADKNKPVLENGGILKAYQLTEKFESFKKIHSQNGFIFYVPAWLTSKIDPTTGFVDLLNPRYTSVEDGKAFIRKFDSIVYNPSEKLFEFSFDYRNFPKGSTDFTGKWTVCSYGKRIETRRDPEANNRFISSEMDITHEWESFFKKWDIAVSENDMKEQILMHDKKDFYVGFMHLLKLTLQMRNSIPGTETDYLISPVRNRNGEFYNSTNYSSTSPLPSNADANGAYNIARKAMWMISKIKNTPDSDLKKACPPITNKEWLEFAQTV

SEQ ID NO: 393 - protein, 1300 aa, unidentified
MTTINKFCGQGNGYSVSKTLCFELKPIGKTLENISTGKFLESDKKKSEDYKDAKKIIDNYHCYFIDDVLKTLSLNWENLAKEINEYRKSKSDDANLLFAQQKQRDEILKVFNSDKRFKALIASTPKDLFNKLLPEWFEKVNSLELKKEAIETFQKFTSYFTGFQENRKNVYSSKVIPTAVPYRIVNDNFPKFLSNISVFEAIQKKCPTVITDVENELKDYLGNEKLSDIFTIQSFNKYLCQSGAANQRGIDFYNQIIGGIVEKDKEENLRGINQFLNLYWQQHPEFAKENKRIKMNPLFKQILSDRTSLSFKIEAIDSDDELIQAIKDCANKLEEKSKEDGKSIFEKCCELFDSINEQDLNEIYINRKDINNFSRILTGDWAWLQARMNYYAEEKFTTKAEKSRYVKSLEDEGENKSKGFYTFAELNDVLKYSSDNIPETNIRIADYFGRRYRYFYEKETGNYIPSEELVALSIEEMCDDILVKRKNMDKAFETSEKEKLQEDSETVSKIKDFLDSLQELLHRVKPLKVNGVEESSFYANFDTIYSSLKEVISVYNKTRNYLTKKAATPEKYKLNFDNPTLADGWDLNKEQANTSVLFRKNGMFYLGIMNPKDKPKFADKYEVKDEDCYEKMIYKLLPGPNKMLPKVFFSTKGKETFNPPKEILSGYEKDRHKKGDSFDIDFCHKLIDWFKNAINQYEDWKKFDFKFSDTKKYKDISDFYREVTEQGYKLSFTNIPVLEIEKMVEDGNLYLFQIYNKDFSPESKGTPNMHTLYWKNLFSEENLKDVCLKLNGKAELFYRPVGIKNPIVHKKDSYLVNKLTKDGKSIPESIYEEIYKNVNGKLDKLSKDAEEYKNTHDVVIKVAKHDIIKDKHYTESKFLFHVPITINFKASGNSYSLNENVRKFLKNNPDVNIIGLDRGERHLIYLSLINQKGEILEQFSFNTVEQSRNDAEPRIIDYHEKLNQREKERDEARKSWQTIGKIAELKEGYLSAVIHKLAQLMIKHNAIVVMEDLNFGFKRGRFHVEKQVYQKFEHMLIDKLNYLVFKDKGLTEAGGVLNGYQLASKFESFQKLGKQSGMLFYVPAGYTSKIDPKTGFVNMFNFKDLTNVHKKRDFFSNFKSISFDNDTDSFVFAFDYKDFNGKAKEEMFISKWSVYSREKRIVYYSKTKSYEDVLITEKLKSIFQKVNIDYTSGNDLLDSIMGIGADLKNGEKPSKDIADFWDDLLYNFKLSLQMRNSNARTEEDYIISPVKSEDGTFFDSREEGKKEHNATLPKDADANGAYHIALKGLSLLKRFDVADE

SEQ ID NO: 394 - protein, 1208 aa, unidentified
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNQNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNCPTLLNGWNLNKEKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFQFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 395 - protein, 1292 aa, unidentified
MKAINSFCGQKNGYSRSITLRNRLIPIGNTNKYIKEFLDKDIERSAAYPAIKKLIDELHRNFIEECLSGVSFPWEPLFDEFELYQNEKDKTKKNVHKKNLVALQAAARRRIVKAFKDNTDFEKLFKEDLFKELLPVLIKNTSDSEIGDKEKAISIFNRFSTYFTGFHENRRNMYSEEEKSTAIAYRIVNENFPKFFANIKLFDYLKNNFPKIIEETEAALKGYLKGKQLKDIFKVEAFNDFLSQAGINFYNTIIGGISGEAGSQKVQGLNEKINLARQQLSKEEKYKLRGKMTVLYKQILSDRETVSFIPSGFENNEEVYSAIEEFNDIIVNGAVSKIKDLFALKNEFNFNEIFVPAKSMAAFSLSTFGNWSIVSEGLFLLEKGKSKKALTEKQEEQLHKDIDKRNCSLKEIQTAYEHYCLENGIDAQIATTKYFDLTEIISDSSERIEANIIDQISKTFAAIDFNNKKDLQQEKEAAIPIKAYLDEVQNLYHHLKLVDYRGEEQKDSNFYSKFDEIVESLSEIVPLYNKVRNFVTKKPGEIKKIKLNFDCPTLANGWDENKEKDNDAILLIREGKYFLGVFNPKDKPKFNSEECTDSDCYKKVVYKLLPGPNKMLPKVFFSTKGQEQYLPPKDLLLDYDAGKHKKGENFDKEFMYKLVDWFKDAINRHEDWKKFDFKFSDTRSYEDMSGFYKEVELQGYKISFKNVSAKTIDDFVDAGKLFLFQIYNKDFAENSAGKKNLHTLYWENLFSEENLRDVCFKLNGEAELFWRKASLDKNKVPVHKKESILVNRITSDGSTIPENIYQEIYQYKNNMNSNISKEAKELLDSAKVVCKKATHDITKDRHFTEDTYLFHCPITMNFKAPEITGRRFNDKVLEVLKDNPDIKIIGLDRGERHLIYLSLINQKGEIELQKTLNLVEQVRNDKTVKVNYQEKLVQKEGDRDKARKNWQIIGNIKELKEGYLSAVIHEIANLMVENNAIVVMEDLNFGFKRGRFAVERQIYQKFENMLIEKLNYLVFKDRSVSEPGGVLNAYQLTDKATNVSDVYKQCGWLFYIPAGYTSKIDPKTGFANLFVTKGLTNVEKKKGFFSKFNSIHYDSKEDCFVFDFDYSEICDNADFKKKWQLYTKGERLIYSKQERKSIAVSPTEDLKKVFDDSGLNWKSGNNLLEDVKNIPAEKQNAKFFDVLLRSFNATLQMRNSIPNTEKDYLISPVRADDGTFYDSRLEAEKGKNNNGNWISKLPVDADANGAYHIALKGLYLLKNDFNRNDKGVIQNISNAEWFKFAQSKEYNN

SEQ ID NO: 396 - protein, 1299 aa, unidentified
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNENRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFENSTLLDGWDVNKETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFFFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 397 - protein, 1303 aa, unidentified
MGKLKDFKRIYSLVKTIRTKLKPIGKTLEHIEKSGILSQDQHRAESYVEVKKIIDEYHKAFIESVLEDFRFSENKGAKNSLEEFFAYYICKSKDETQKRQFADIQDKLRKQIAKRFSDDDRFKRIDKKELIKEDLLSFVEEVEKRQLIKEFKDFTTYFTGFHENRKNMYTDEAQSTAIAYRLIHENLPKFIDNIMVFDKVAASPIAEHFAKLYSDFEEYLNVSELGEMFCLDYYNIVLTQTQIDVYNAIVGGKTLEDGKKIQGLNEYINDYNQQQKDKSARLPKLKPLYKQILSDRNAISWLPEQFQSDEKVLEAIQKAYQDLDEQVFNRKKEGEHSLKDLLLSLSNFDLSKIYIRNDAQMTDISQKAFGHWDVIHKALLEQLKKDVQKKPKNESDEAYEERLKKTIKSQGSIPIALINQGVQKQNSEEQNTLLTYFASLGAVETESVKKENLFTQIENAYAEVKDLLNTPYSGKNLAQDNVAIEKIKSLLDAVKALQHFVKPLLGDGTESEKDEKFYGEFSMLWEELDKITPLYNMVRNYMTRKPYSTEKFKLHFENNGSLLNGWVDSKTENSDNGTQYGGYLFRKQNIIGEYDYYLGISSDTKLFRRDAVINDTDKSEFERLDYYQLKSQTVYGKSYQGDYNQESAQIISAIDSFVERTTNTNLKEKINQDRETKNPKTSTAKGYLNFLRKNSEIYDSIINDYAFVKANLQLITSIKKTLRAFKRIPQAQKLAQKEFVLFVDLMNEIDEMVKEKVFTYVPISLKEFENSMERDKKPLFLFKISNKDLSFAESYEKGLRKSRGTDNLHTMYFKALMNGNQNVFDIGTGVVYFRKHSIQYSDEKMKTGHHHNVLKDKFKYPIISNKRYVYDQFQFHLSIEQNYLAGKIGDFEMNRRVNEYIRQSDDLHIIGIDRGERHLLYLTVIDLQGRIKEQYSLNEIVNTYNGNEYRTNYHDLLSKREDERMKARQSWQTIKNIKELKEGYLSQVIHKISELIVKYNAIVVLEDLNMGFMRGRQKVESSVYQKFEKMLIDKLNYLVDKKKNPEEDGGVLNAYQLTNKFDSFQKLGKQSGFLFYTQAWNTSKIDPVTGFVNLFDTRYETREKAKDFFGKFDAIRYNTAKDWFEFAFDYSEFTSKAEGSRTNWTLCTYGERIETFRDEKQNSNWATRKINLTDKFKELFEKHKIDIQADLKEAISQQDSADFFKGLLYLLKLTLQMRNSEIGTEIDYMQSPVADANGNFYNSDTCDDSLPKNADANGAYNIARKGLWIVQQIKAADDLKNVKLSISNKEWLKFAQEKPYLNE

SEQ ID NO: 398 - protein, 1252 aa, unidentified
MKDLKQFIGIYPVSKTLRFELRPVGKTQEWIEKNRVLENDESKAADYPVVKKLIDEYHKVCIRESMKDVHLDWAPLKEAMEEYQKKKSDDAKKRLEAEQTMMRKRIATAIKDFRHYKELTAATPSDLITSVLPEFSDNEALKSFRGFASYFIGFQENRNNIYSPDAISTGVPYRLVHDNFPKFLSNLEVYDKIKATCPEVIQQASEEIQPFLEGVMIDDIFSLDFYNSLLTQDGIDFFNRVIGGVSEEDKQKYRGINEFSNLYRQQHKELAGSKKALTMIPLFKQILSDRDTLSYIPAQIETENELMTSISQFYKHITYFERDGKTINVLNELVALLSKIDTYNPDGICVTANKLTDISQKVFGKWSIIEENLKEKAVQQFCDISVAKNKKKVDAYLSRKAYCLSDLCFDDEFHISQYFSDLPQTLNAIEGYWLQFNEWCKNDEKQKFLNNPAGTEVVKSLLDAMMELSHKCSVLVMPEEYEVDKSFYNEFIPLYEELDTLFLLYNKVRNYLTRKPSDVKKFKLNFETPSLADGWDQNKERANKAILLFKDGLSYLGIMNAQNMPNLNQKWSADESHYSKMVYKLIPGPNKMLPKVFFSKKGLDIFNPSRHILRIKEEETFKKGSPNFKLADLHDLIDFYKDGINRHPDWSKFNFQFADTKAYEDIAGFYRDIANQAYKITFSDIPVWQINDWIDNGQLYLFQLYNKDYAEGAHGRKNLHTLYWENLFTDENLSNLVLKLNGQAELFCRPQSIKKPVSHKMGSKMLNRRDKSGMPIPESIYRSLYQFYNGKKKESELTAAEKQYMDQVIVKDVTHEIIKDRRYTRQEYFFHVPLTFNANAEGNEYINENVLNYLKDNPDVNIIGIDRGERHLIYLTLINQRGEILMQKTFNVVNSYNYQAKLEQREKERDEARKSWDSVGKIKDLKEGFLSAVIHEICKMMIENNAIVVLEDLNFGFKRGRFKVERQVYQKFEKMLIDKLNYLSFKDREAEEDGGILRGYQMAQKFVSFQRLGKQSGFLFYIPAAYTSKIDPITGFVNHFNFNDITNAEKRKEFLMKMERIEMRNGNIEFEFDYRKFKTFQTDYQNLWTVSTYGKRIVMRIDDKGYKQMVDYEPTKDIVNTFKNKGIQLTEGSDLKALIADIEANATNAGFFNTLLYAFQKTLQMRNSNAATEEDFIFSPVARDGRYFCSMDEANKGRDAQGNWVSKLPIDADANGAYHIALKGLYLLRNPETKKIENEKWLQFMVEKPYLE

SEQ ID NO: 399 - protein, 1228 aa, unidentified
MKNFHNIYSLSKTLRFELKPLAVNDKEKLTEKKEIMEPFVSIDEKKADAYKEVKHYLDELHREFIRKTFTNFEISSEELEAAYKTFDSSNHNDDAKETYKKITERLHKQIVTHLNKSEEKKDLFGKKVIVLLKNKFQSNEEAMNMISEFDKFTTYFNGYNQSRENMYNQKIPERLINDNLPKHYKNVKDYQKIRELLPDELRQLSQDFGINTDVLFSVNYFNKIMTQLGIDKYNEIIGGRSEEEGQKIKGLNEYINEYNSIHKKEKVFLPKFQQLYKQILSEKIKSNSFRYSELKDIDELTKEIDAYYEELNQKVLTPKTLVKLLENLASENYELDNIYIGMPYINYISSRVFNHWDYIATEIKSAFSDDKSMRKTIEALESEDNDSKNKKFISFGLLRQALLKDDKDGFTELMKYFAEMKAPPKGSQKRNLNLFENINEAHKKYLEDKGKISNIKALLDAIKDLQNFIRVFSFNETVDTDAAFYNVLNEQYAVLRKIILLYNRARNLATKKPYSLEKFKLNFNCPTLLDGWDANKEQDNLSILLRKDGLYYLGIINSKHKKDAFEKLNQELLENNKECYEKIEYKLLPGANKMLPKVFFSQKGIEEFHPSTDLLEKYEKGYHKKGDSFDINFCHELIDFFKSAISKHKDWSKFNFHFSPTESYEDMSNFYKEIEMQGYKITFRNIAAANIHNLVKTGKLYLFKIHNKDFSEYSHGTPNLHTMYWRALFDEDNLKNVVYKLNGEAEIFFRKKSIDENKIIKHKANEPIRKRRNENQYSRFAFDLIKDKRFTVDKFQFHVPITLNFKAQGKNNINDLVREHIKNSDNISVIGIDRGERNLLYYSLIDSKGNIKEQGSLNVIGEKFQTNYHHLLDEKEKNRETAREEWQKIEKIKDLKTGYLSQAIHKITKLMIENNAIVVLENLNRGFKRSRIKIEKQIYQNFEKMLIEKLNYLVIKNKKEKTEEGGILNAYQLTSKFKSFEKLGTQSGFLFYISPWYTSNIDPTTGFVNLFQTKYQNIEKTKQFINKFKDIRYNEKEGYFEFEVDDYKKFTDKATGRKKDWVICTYGDKIIHERINGKWNSKNCDIANEFLNLFKNNNVNLDNIKENCASITDANFFRKFLKLFEYTVQLRNSYKTEAAHLTRSIDTDDCKDMVEKERKKDYILSPIKSKNGEFFDSRKASHSLPIDADANGAYNIARKGLMVIKQIKRDEKIKISNEDWLNFAQENS

SEQ ID NO: 400 - protein, 1307 aa, unidentified
MKTIEQFCGQKNGYSRSITLRNKLIPIGKTEENIEKLKLLDKDKERSKAYVEVKQMIDDFHRSFIEDVLSKAKFDEWGALYDQFDLFQNEKDKQKKNKIKKKLETLQGVMRKQIVKKFKDDDRFDKLFKKELLTEFVPTVIKADESGAISDKQAALNVFKGFATYFTGFHQNRQNMYSEEAQATAFSNRIVNENFPKFYANVKVFEYLQKNFPEIISQTEQSLSEILKGKKLADIFSADGFNAVLSQTGIDFYNTIIGGVAGEAGTQKLQGLNEKINLARQQLPAEEKSKLKRKMTVLYKQILSDRSTASFIPVGFESSEEVYESVKQFKEQSLNKILSEVKMLFEKSDYDLNQIYVPAKEITGFSLKLFGNWSILHDGLFLIEKDSAKKNLSEKQVEAIRKEIAKRDCSLVDLQNAYERWAKENDVAVEKTVKNYFRIAELRTVEESKEKAFVEILKSIESAFEKIDFEKQENLIKEKESATPIKDFLGETQNLYHYLKLVDYRGEEQKDTDFYSKFDEILQTLSEIVPLYNKVRNFVTKKPNEVKKVKLNFDCPTLASGWDLNKESSNDAIILRKNGNYYLGIFNSKDKPKFDNCSTEGECYEKMIYKLLPGPNKMLPKVFFSTKGQETFLPPKENLLGYEAGKHKKGDNFDKAFMYKLIDWFKNAINKHEDWKNFNFKFSPTESYEDLSGFYKEVEAQGYKITFQKVAESYINSLVDSGKLFLFQIYNKDYSTGKDGGNGSTGKKNLHTLYWENLFSEENLRDVCLKLNGEAELFWRDANPDVKDVCHKKGSILVNRTTSDGETIPEEIYQEIFKFKNPDKQEENFKLSDAAKELLDSGKVVCKEAKFDITKDRHFTQKTYLFHCPITMNFKAPEITGKKFNEKVQQILKNNPDVKIIGLDRGERHLIYLSLINQKGEIELQKTLNLVEQVRNDKTVSVNYQEKLVQKEGERDKARKNWQTISNIKELKEGYLSNIVHEIAKLLIENNAIVVMEDLNFGFKRGRFAVERQVYQKFKNMLIEKLNYLVFKDKKVTEPGGVLNAYQLTDKAANVSDVGKQCGWIFYIPAAYTSKIDPKTGFANLFYTAGLTNIEKKKDFFDKFDSIRYDKKTDSFVFSFDYSEFGDNTDFKKKWEVYSKGERLVFSKAEKSVIHVNPTENLKALFDKQGINWNSEDNFIDQIHEVQAERENCAFYDGLYRSFTAILQMRNSVPNSSKQEDDYLISPVMADDGTFYDSRVEVAKGKDETGKWISKLPVDADANGAYHIALKGLYLLQNNFNLNEKGYIENISNADWFKFVQEKNYAE

SEQ ID NO: 401 - protein, 1303 aa, unidentified
MKTIGKTLENISTGKFLESDKKKSEDYKDAKKIIDNYHCYFIDDVLKTLSLNWENLAKEINEYRKSKSDDVNLLSAQQKQRDEILKVFNSDKRFKALIASTPKDLFNKLLPEWFKKDNSVELNKEATETFKRFYSYFKGFQENRENVYSSKEIPTAVPYRIVNDNFPKFLSNISVFETIQKKCPDVITDVENELKEYLGNEKLSDIFSIQSFNKYLCQSGAENQRGIDFYNQIIGGIVEKDKEQNLRGINQFLNLYWQQHPEFAKNNKRIKMVPLFKQILSDRTSLSFKIEAIDSDDELIQAIEDCANKLEEKSKDDGKSIFEKCCELFDSINEQDLNEIYINRKDINNFSRILTGDWAWLQARMNYYAEEKFTTKAEKSRWVKSLEDEGENKSKGFYTLAELNDVLKYSSDNIPETNIRIADYFGRRYRYFYEKETGNYIPSEELVALSIEEMCDDILVKRKNMDKAFETSEKEKLQEDSETVSKIKDYLDSLQELLHRVKPLKVNGVGESSFYANFDTVYNALKEVISVYNKTRNYLTKKVASPEKYKLNFDNPTLADGWDLNKEQANTSVLFRKNGMFYIGIMNPKDKPKFAEKYEVKDEDFYEKMVYKLLPGPNKMLPKVFFSTKGKETFNPPKEILNDYEKGKHKKGDSFDIDFCHKLIDWFKNAINQHEDWKKFDFKFSDTKNYKDISDFYREVTEQGYKLSFTNIPVSEIEKMVEDGKLYLFQIYNKDFSSESKGTPNMHTLYWKNLFSEENLKDVCLKLNGEAELFYRPVGIKNPIVHKKDSYLVNKLTKDGKSIPENIYEEIYKNANGKLDKLSKDAEEYKRTHDVVIKVAKHDIIKDKHYTVPKFLFHVPITINFKASGNSYSLNENVRKFLKNNPDVNIIGLDRGERHLIYLSLINQKGEILEQFSFNTVEQSRNDAEPRIIDYHEKLNQREKERDEARKSWQTIGKIAELKEGYLSAVIHKLAQLMIKHNAIVVMEDLNFGFKRGRFHVEKQVYQKFEHMLIDKLNYLVFKDKGLTEAGGVLNGYQLASQFESFQKLGKQSGMLFYVPAGYTSKIDPKTGFVNMFNFKDLTNVHKKRDFFSNFKSISFDNDTDSFVFTFDYKDFNGKAKEEMFISKWSVYSREKRIVYYSKTKSYEDVLITEKLKSAFQKVNIDYTNGNDLLDSIMGIGADLKNGEKPSKEVADFWDTLLYNFKLILQMRNSNARTEEDYIISPVKAPDGTFFDSREEGKKEHNATLPKDADANGAYHIALKGLSLLKRFDVADEKSLKKFDMKISNADWFKFVQEKEYKD

SEQ ID NO: 402 - protein, 1295 aa, unidentified
MKTIDSFCGQNEGYSRSITLRNKLIPIGETEKNIKEFLEKDVERSEAYPQIKKLIDDIHRGFIEECLSNVSFPWEPLFDQFELYQNEKEKIKKNAKKKELIVLQVAARKRIVKAFKDNKDFEKLFKEELFKELLPQLIKSAPVTEIADKEKALSVFTRFSTYFNGFHENRKNMYSEEEISTGIAYRIVNENFPKFFSNIKLFEYLKDNFPEIIKETEISLKDTLKGKKLCDIFKVEAFNNVLSQSGIDFYNTIISGVAGEGGTQKIKGMNEIINLAKQQLPKEEKDKLHGKMVVLFKQILSDRETASFIPTGFEKNEEVYASIKEFNNIIVKDSVTETRNLFALNSDIKLNEIIVPAKSITAFSLTIFGNWVIISEGLYLLEKDKITKALSEKQEEQLHKDIDKKDCNLEEIQSAYERWCSENGEIVRTSVRKYFNLIETQSSSSENTSTKKEVCILDEITKSFSQIDFENEKDLQQEKEAATPIKIYLDEVQNLYHHLKLVDYRGEEQKDSNFYSKFDEIIEKLSEIISIYNKVRNFVTKKPGEVKKVKLNFDCPTLANGWDENKEKDNDAILLLKDGNYYLGIYNPKNKPKFDFEESKASDCYKKVVYKLLPGPNKMLPKVFFSAKGQKEFLPPKELLLGYEEGKHKKGENFDKEFMYKLIDWFKDAINRHEDWKKFDFKFSDTRSYEDMSAFYKEVELQGYKISFKKVSTEIINEFVNSSKLFLFQIYNKDFAVKATGKKNLHTLYWENLFSEENLKDICFKLNGEAELFWRKASLIKEKVTVHKKNSILINRTKKDGSTIPENLYQEIYQYKNNMISDISENAKDLLNSGKVICKKATHDITKDKHFTEDAYLFHCPITMNFKAPEITGRKFNDKVLEALKENPEIKIIGLDRGERHLIYLSLINQKGEIELQKTLNLVDQIRNDKTVQINYQEKLVQNEGDRDKARKNWQTIGNIKELKEGYLSAIIHEIATLMIENNAIVVMEDLNFGFKHGRFAVERQVYQKFENMLIEKLNYLVFKDRSIKEPGGVLNAYQLTDKAANVSDVYKQCGWLFYIPAGYTSKIDPKTGFANLFVTKGLTNVEKKKDFFSKFDSIYYDEKEACFVFAFDYSKFGDNADFKKKWEVYTKGERLVYSKQERKSITVSPTEELKKIFNEFSINWNNSESVLDQIKTIPAEKLNAKFFDTLLRAFNATLQMRNSVPNSSRQEDDYLISPVKARDGTFYDSRIEAEKGIDKNGRWVSKLPVDADANGAYHIALKGLYLLENNFNRNEKGVIQNISNVEWFKFAQTK

SEQ ID NO: 403 - protein, 1251 aa, unidentified
MKDLKQFIGIYPVSKTLRFELKPIGKTLEWIKKNKVLESDEQKAEDYPKVKTLIDEYHKVCICESLKGVNFDWNPLRLALKEYQSSKSDESKAVLEKEQALMRKQIATVIKDFRHYKELTTPTPQKLIDNVFPSIYESDALKSFNRFAVYFKGFQENRNNIYSSDAISTGVPYRLVHDNFPKFLADIEVFENIKTNCPEVIEQAATELQPFLEGVMIEDIFTIDFYNSLLTQDGIDFFNQVLGGVAEEGKQKYRGINEFSNLYRQQHPEQTAKKKTLTMIPLFKQILSDRDTLSYIPQQIESEQQLIELLNQFYSHITAFDYNGKTVDVLKELTKLTGNINKYNPDGIYLSAKSLTDVSQKLFSKWNVITERLSEEAIKRFGDVSITKNKKKIDAYLSKDAYALSEIPLDNDHSLSMFFAEFPKTIENVGSNWLQFMEWCKGESKQLFLNNADGTEIVKNFLDSIMEILHRCSVLVVSVEHDLDKDFYNDFLPLYAELENAVMVYNRVRNFLTKKPSDTKKFKLNFGVPSLGDGWDQNKERDNKAIILFKDGKSYLGIMNAKDMPIIKERDESTPSSYKKMIYKLLADPAKDFPHTFFSKKGIDTYHPSRYILDGREQGKYKKGETFDKKFMRDFIDFYKDAVAKHPIWSKFNFVYSPTESYEDIGAFFNEVSKQAYKIRFSYIEESQINEWTEKGQLYLFQLYNKDYAEGAHGRKNLHTLYWESLFSPENLSNIVLKLNGQAELFYRPQSIKQPFSHKTGSKMLNRRDKSGMPIPEAIYRSLYQYFNGRKAESELTLVEKSYIDQVVVKDVTHEIVKDRRYTKPEFFFHVPITFNVNADGNEYINEQVMEYLKDNPDVNIIGIDRGERHLIYLTLINQRGEILKQKTFNIVGNYNYHAKLEQREQERDQARKSWQSVGKIKELKEGFLSAVIHEIAMMMIKYNAIVVLEDLNFGFKRGRFKVERQVYQKFEKMLIDKLNYLSFKDRKPDEAGGILRGYQLTQQFTSFQRLGKQSGFLFYIPAAYTSKIDPVTGFVNHFNFNDITNAEKRKAFFMKMERIEMRNGDIEFEFDYRKYKTYQTDYQNIWTVNSSGKRIVMRIDENGRKQMTDYFPTKEIVKAFSDKNITLCEGTDLKALMAVIDTSPKNASLYGTLFYAFQKTLQMRNSDSATEEDYILSPVTQNGKQFNTKDEADKGQDSAGNWVSKFPVDADANGAYHIALKGLFLLMNQQTKKIENQKWLQFMVQKPYKS

SEQ ID NO: 404 - protein, 1323 aa, unidentified
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNENRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLNGWVDSKTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 405 - protein, 1280 aa, unidentified
MNLDSFTRKYKLAKTLRFELRPIGKTLQTFREKFLPGDERRDVAYPGVKELLDDQHKALLERTLSNPPPLDWERLARACEEYRSSDKSKEAKDALAAEQAAFRKALAAHFKSDQAFALLTAPTPQKLFKSLQDEYARKKVPLPDDLATFLRFSCYFKGYQENRRNIYSDEPQATAAANRAVNENFQKFLEDIRIVRHISEKYPEILADAERELSPLLKGKPLASLFEPAAYGGFLAQSRIDFFNSVLGGFVPAEGEKTRGINEFVNLYRQQHEEARADRALVPLRPLYKQILSDRESHSLVPRMFENDETVVSAIRDMLEGQFLALHLQEDVVNVPDALQSLLATLSPSPTIWVDGADISRVSKDLLGSWDALTALMESAAEARFASESTERKRLDAVEKWLKKPVFSLAELGNLREETDTGTTVVNVSELWKGPVAAERFAAVRTAVTEVVPALASAMSDKETPLRERKELVAKIKEALDAILDLLHFVKPLHAGEGLDRDDAFYGMFDMLYDALDGFVPLYNKVRNYLTRKPGETERVKLMFDNPTLADGWDQNKEKDNTCVLFVRDGLYYLGVMAPSAKTDFSKLAAPETPGCYRKMIYKLLPGPNKMLPKVFFSKKGEALFHPSAALLAKYRAGVYKKGEGFDLAFCHELIDFFKSAIAMHPDWSKFGFRFSPTKSYNGIDEFYREVSEQGYAISFENIPDATIARLVEEGKLCLFLLWNKDFSKASTGRPNLHTQYWNAVFSPENLRDVTLKLNGEAELFFRPKSIREPFRHKVGEKMVNRRGRDGSPIPESVHGELFRHVNGSPEPLSDAARAWLSSGNLVIKYVAHEIVKDARFAEDKFSFHVPITINFKQPDAPARFNDQVREFLLANPDVNVIGIDRGERNLLYLALVDRKDNLLEQRSFNVVSQLRRDGVPMRTDYQARLVQSEKDRAEARASWAEIGAIKDLKEGYLSAVVHEIAKMMVERNAVVVLEDLNRGFKRGRFRIERQVYQKFEKALIDKLNYLVFKDRGMAEPGGTLRGYQLTNAFESFEAIGKHKQTGFLFYVPAGYTSKIDPTTGFTNLFNTKKCANAVGVRDFFAAFDSIRWDAARHAFAFSFDYANFKTSQESHRTKWTVFSADRRLVFDKDAKSEKEINPTAIILAALAARGVAVADGFDLQALLLATEPSKANAAFFRSVFYAFDRTLQMRNSSSRTGEDYIQSPVLNGRGEFFDSRKAAPGLPVDADANGAYHIALKGLQLLEENLAAKTPDLKIEYKAWFRFAQELAAQKFRQA

SEQ ID NO: 406 - protein, 1229 aa, unidentified
MFHNIYSLSKTLRFELKPLAVNDKEELIENKKIMEPFVSADEKKATAYKEVKGYLDKLHQEFICKTFTNFEIPSEELEAAYKAFCSSSHNDNKKEIFEKITEKLRKQIKKHLNKNEEKKDLFGKKVIVLLKNKFQSNEKAMKMISEFDKFTIYFGGYNQSRKNIYDQKIPERLINDNLPKHYKNVKDYQKIRELLSNELRQLSQDFGINTDVLFSVNYFNKIMTQTEINKYNEIIGGRSEKEGQKTKELNEYINEYNSIHKKEKISLQKFQQLYKQILSEVESKSFRYSELKDIDELTKEIDTYYEELNQKVLKPKTLVKLLEDLASENYELDNIYISMPYINSISSRVFYRWDYIATEIKNAFSDSKDKSIKKTIKALESEDNDSKNKKFISFGLLRQALLKDDKDRFAKLMKYFAEMKADQKISQKRNLNLFENINEAHEKYLGNKKDISNIKVLLDAIKGLQEFIRVFAFNEAIDTDAAFYNVLNEQYAVLRKIIYLYNRARNLATKKPYSLEKFKLNFDCPTLLAGWDVNKEQDNLSILLKKDGLYYLGIISSNSKHKKDVFEKLNQELSENTKECYEKIEYKLLPGANKMLPKVFFSQKGIEEFYPSADLLEKYEKGYHKKGESFDINFCHELIDFFKSAISKHEDWSKFDFHFSPTESYEDMSGFYREVEEQGYKITFRNIAATNIYDLVKTGKLYLFKIHNKDFSEYSHGTPNLHTIYWRALFDEDNLKNVVYKLNGEAEMFFRKRSIDENKIIKHKANEPIPQRRNENKSSIFAFDLIKDKRFTVDKFQFHVPITLNFKAQGKDNINDLVREYIKNSDDISIIGIDRGERNLLYYSLIDPKGNIKEQGSLNIIKEKFQTNYHHLLGEKEVDRKKAREEWQEIEKIKDLKTGYLSQAIHKITELMIKNKAIVVLENLNGGFKRSRIKIEKRIYQNFEKMLIEKLNYLVIKNKEEKTEEGGILNAYQLTSKFVSFKKLGIQSGFLFYISPWNTSNIDPTTGFVNLFQTKYQNIEKTKQFISKFKDIRYNEKEGYFEFEVDDYEKFTDKATGNKKDWIICTYGDKIIHERINGKWNTKNCDITNEFHKLLKDNNVSLDNIKEDCASITDANFFRKFLKLFEYTVQLRNSDKTEERNLTRSIDTDNYKDIVKKERKKDYILSPVKNKNGEFFDSRKNFHSLPIDADANGAYNIARKGLMVIEQIKRDEKIKISNEDWLNFAQKNC

SEQ ID NO: 407 - protein, 1293 aa, unidentified
MARIIDEFCGQMNGYSRSITLRNRLVPIGKTEENLKQFLEKDLERATAYPDIKNLIDAIHRNVIEDTLSKVALNWNEIFNILATYQNEKDKKKKAAIKKDLEKLQSGARKKIVEAFKKNPDFEKLFKEGLFKELLPELIKSAPVDEIAVKTKALECFNRFSTYFTGFHDNRKNMYSEEAKSTAISYRIVNENFPKFFANIKLFNYLKEHFPRIIIDTEESLKDYLKGKKLDSVFSIDGFNSVLAQSGIDFYNTVIGGISGEAGTKKTQGLNEKINLARQQLSKEEKNKLRGKMVVLFKQILSDRETSSFIPVGFANKEEVYSTVKEFNNSIAEKAVSKVRDLFLHREEFTLNEIFVPAKSLTDFSQAIFGSWSILSEGLFLLEKDSMKKALSESQEEKINKEIAKKDCSFTELQLAYERYCTEHNLPVEKFCKDYFDIVDYRGNGAKSEKTKVSILSEILETFLQLDFDHIQDLQQEKNAAIPIKAYLDEVQNLYHHLKLVDYRGEEQKDSTFYSKHDEILTDLSQIVPLYNKVRNFVTKKLGESKKIKLNFDCPTLANGWDENQESSNDAIILRKDGKYYLGIYNPNNKPKFAKKDSIVGDCYEKMAYKQIALPMGLGAFVRKCFGTAQKYGWGCPENCLNSEGKIIIKDEEAKGNLEAIIDCYKDFLNKYEKDGFKYKDYNFSFLDSASYEKLSDFFNDVKPQGYKLSFTSIPLSEIDKMIDEGKLFLFQIYNKDFAKKATGKKNLHTLYWENLFSVENLQDVVLKLNGEAELFWREASIKKDKVIVHKKGSILVNRTTTDGKSIPEAIYQEIYQLKNKMADSISDEAKRLLESGTVVCKVATHDIVKDKHFTENTYLFHCPITMNFKAKDRTNKEFNNHVLEVLNKNPDIKVIGLDRGERHLLYLSLINQKGEIECQKTLNLVEQVRNDKTVSVNYHEKLVHKEGSRDAARKNWQTIGNIKELKEGYLSAVVHEIASLMVKHNAIVVMEDLNFGFKRGRFAVERQIYQKFENMLIEKLNYLVFKDRKVTEPGGVLNAYQLANKSAKVTDVYKQCGWLFYIPAAYTSKIDPRTGFANLFITKGLTNVEKKKEFFGKFDSIRYDATESCFVFSFDYAKICDNADYKKKWDVYTRGTRLVYNKTERKNVSVNPTEELQCVFDEFGIKWNTGEDLIESISLIPAEKSNAKFFDVLLRMFNATLQMRNSVPNTDTDYLVSPVKAEDGSFFDSREEFKKGGDARLPIDCDANGAYHIALKGLYLLLNDFNRDNKGVIQNISNKDWFKFVQEKVYKD

SEQ ID NO: 408 - protein, 1261 aa, unidentified
MLSLHKLKTNAIMKDLKQFIGIYPVSKTLRFELRPIGKTQEWIENNKILESDEQKSLDYPKVKALIDDYHKVCIRESLKGVHLDWTPLKQALEDYQETESDENKATLEKEQTLMRKQIASAIKDFRNFKELTAPTPQKLIDDVFPGIYESDALKSFNRFALYFDGFQKNRNNIYSTEAISTSVPYRLVHDNFPKFLTNIDVYENIKTTCPKVIEQVASELQPFLEGVMIDDIFTLDFYNSLLTQEGIDFFNQVLGGVAEEGKQKYRGINEFTNLYRQQHPELIGKKKGLTMVPLFKQILSDRETLSYIPQQIESEQQLIDVLGQFYNHITNYEYNGKTINILKELSNITNKTDSYNPDSIFLSSKTITDVSQKLYGRWGAINDMLNERAVTLYGDPNIIKNKKKIDAYLAKDAYSLSELCLDGEHELSVYFSEMSHFMDQVSFNWLQFKEWCKGKNKQLFLNNADGTEMVKNLLDSIMEILHRCSVLVVPIEYDLDKDFYNDFLPLYAELENVIFVYNRIRNYLTQKPSDTKKFKLNFGTPSLGDGWGVNNERKNKAILLFKDGLSYLGIMNVKGTLKFEESKDSSSPSYKKMTCRYLSKPFMDLPHTFFSDKGLSTFHPSDYILDIYKSGSFKKDSPSYSKSSLYALIDFYKESINKHEDWTKYGFTFSPTDSYEDISSFYSEIAKQAYKISFTNVSEKQINEWVENGQLYLFQLYNKDYAEGAHGRKNLHTLYWENLFSEENLSNLVLKLGGQAELFYRPQSIKKPVKHEVGSKMLNRRDKSGMPIPESIYRNLYQYFNGRKSDSELTPEDQKYIDQVIVKETNHEIIKDRRYSKPEFFFHVPIVFNANADGNEYINEQIMDYLKDNPDVNIIGIDRGERHLIYLTLINQRGDILKQKTFNMVGNYNYHAKLEQREKERDQARKSWQSIGKIKDLKEGFLSAVIHEIAVMMIENNAIVVLEDLNFGFKRGRFKVERQVYQKFEKMLIDKLNYLTFKDRKADEEGGILRGYQLAQQFTSFQRLGKQSGFLFYIPAAYTSKIDPVTGFVNHFNFNDITNAEKRKAFFMNMERIEMKRGNVEFEFDYRKFKTYQTDYQNIWTVNTSGKRIVFNAERREAKDIYPTQEIIAAFKGRGIVLKDGMNLKELIVDIEPNAKNAAFFGTLFYAFQKTLQMRNSNATTEEDYILSPVVRNGKQFCTTDEVNMGKDANGNWISKLPVDADANGAYHIALKGLYLINNPQIKKIENEKWFQFMVEKPYLE

SEQ ID NO: 409 - protein, 1254 aa, unidentified
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNKNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDNPQFLKGWPTSLEIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFSLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 410 - protein, 1262 aa, unidentified
MKNLKEFHNLYPVQKTLRFKLEPIGKTEEFIERAQILENDERRADEYLKVKEYIDRYHREFIENALSQPLLKVESEGKQDSLEDFADCYNNDNSEKRSDNLEKIQDKLRTQIVKGFSKLPAFARIAKKELIKEDLPKFLKDKNEKEIVSHFDEFTTYFTGFHQNRMNMYTAEAKSTSIAFRLINQNLVKFVDNSNILEKVVPVLGKDIIAQLDKDFEPFLNVDSALDLFKIDNYNEVLTQLQIELYNAIIGGRVDEGNKVEIKGLNQYINEFNQTHEKSLRIPKLKPLFKQILSENVGVSFRMEQFTDASQVQTAIKEEYIKLESSVFDKLKEMIKSLPTFNLNGIYLANDLGLTDICQRYYGAWDKLNNALVAEFDAVVPRKKTQSQEKRDNQVKKYLKSVKSISLGKIDSLLADVTEKSIVDYFTNLGAIDNETTQRENLFALIQNRYISLKEVLDCPTPSDELLRKNIEGIKDLLDAIKDLQRFIKPLCGCGEELDKDEMFYSDFSPLYETLDDIITPLYNKVRSYLTKKPYKLDKFKLNFETPTLLQSWPNYQAYSCAIFKEDDNHYYLAILDKNNRSCLNTIVPPISKNDIIGLVKHLQGGDMGKNVQNLMRIDGKTRKVNGRKETSGPNAGQNIRLEESKKTYLPHEINEIRIEKSFSLNSPNYRRECLNKYIDFYKPLVEEYYSEFDFEFKEASEYRDFSQFTNHINQQSYQLKIIPFSKKYLKTLVDNGQVFLFRILNKDFSPYSKGRPNLHTIYWKMLFDDNNLKDVIYKLNGKAEMFFRRSSITNPVIHAANKEIANKSAYNKQHKAVSKFDYDIIKDRRFTRNQYEFHVPITMNFKSAGSVRFNQEVLSFIKEKGIKHIIGIDRGERHLLYLTMINMKGEIVEQFSLNDVASNPNNPEYKQDYNELLSIKEGDRLSARRNWSTIENIKELKSGYLSQIVHLLSKMMIENDAILVLENLNTGFMRGRQKVEKSVYLKFEKMLIDKLNYVVDKTAAPNEPSGALKALQLTDTYDNFNKYQKGNVRQCGFVFYIPAWNTSKTDPVTGYVNLFDTRLSTIGEIKSFFSKFDRIKYNSKNDAFEFTFDYNNFTTRAEGTRTCWTISSQGERIFTHRSKEQNNQFVSETVHPTQIFKDVFKMAGCEINGNLKEGIASIESLEPLKQLLHAFKLVIQMRNSITGTEVDFLLSPAIDAKGTNFDSRKGISTLPENADANGAYNIARKGLMIVEQIQNADDIANIKYSVSNNDWLKFAQG

SEQ ID NO: 411 - protein, 1272 aa, unidentified
IDNYHKFFIDDVLKNANFDWTVLEKEMSDFNKSKADDSKVEAEQKKLRDQIAKKMTSDKRFKALTASTPSDLFNKDKDFIDWFTQNSTKDINKEALETFKRFSSYFKGFQENRKNVYSAEPIPTAVPYRLVNDNFPKFLQNIALFKIIQEKCPQVISDVEKELASYLGKEKLADIFTVQAFNKYLCQGGKENQRGIDFYNNILGGIAEKEGGINLRGINQFLNLYWQQHPDFAKQNKRIKMIPLFKQILTDRENFSFKIETIDTDEELKTAIAEYADKLETKSNDEKKSVLDICRDLFASIKEQNLQEIYINRKDINNISRILTGDWSWLQSRMNAYADEVFTTKAEKTRWQKSVDGDEGENKSKGVFSLAELNRVLEYSSENVAETDIRITDYFDHRNRFYYEKESGLFKQGDELVALSIKESCEDILAKRKAMDEAFANVNESNSLRDNSESIAKIKTYLDSVQGLFHRIKPLKVNGLGDPSFYAVFDTVYNALNEVISLYNKTRNYITKKAASPEKYKLNFDNPTLADGWDLNKEQANTSVLLRKDGMYYLGVMNPKDKPKFAEKYECGNEACYEKMIYKLLPGPNKMLPKVFFSTKGKETFNPPENILQGYEQGKHKKGNSFDINFCYELIDWFKSAIKKHEDWKKFDFVFSDTKSYKDISDFYREVTEQGYKLSFINIPEATISQMVSEGKLYLFQIYNKDFAPGASGMPNMHTLYWKNLFSEENLKNVVLKLNGEAELFYRPAGIKEPVIHAKGSYLVNRITKDGEPIPEKIHDEIYRNANGKLESLSKEATEYKASHKVVIKEAKHDIIKDRHYTEPKFLFHVPLTINFKASGNSYINENVRRFLKNNPDVNVIGLDRGERHLIYLSLINQKGEIIKQFTFNEVERNKNGQVIKVNYHEKLDQREKVRGAARKSWQAIGKIAELKEGYLSAVIHQLTKLMVEYNAIIVMEDLNFGFKRGRFHVEKQVYQKFEHMLIDKLNYLVFKDRGLTEAGGVLNGYQLAGQFESFQKLGKQSGMLFYVPAGYTSKIDPKTGFVSMLNFKDLTNVHKKRAFFSKFDDIHFDDATGSFVFTFDYKNFDGKAKEEMKQTKWSVYSKDKRIVYYPKEKTYEDVLPTEKIKTSLESVGIEYVSGNNLIDSIMAIGAELKDGAKPSKEIADFWDGLLYNFKLILQMRNSNARTGEDYIISPVMADDGTFFDSREEFKKGENAKMPVDADANGAYHIALKGLSLLKRLDAASENELKKFDMKISNADWFKFAQEKSYAE

SEQ ID NO: 412 - protein, 1306 aa, unidentified
MKTIENFCGQKNGYSRSITLRNALIPIGKTEENIQKFELLKNDFKRANAYGEIKNLIDDFHRSFIEDVLSKASFEWGPLYDQFELFQKEADRQKKDKHKKELESLQSAMRKQIVKKFTADERFKKLFAKELLSDLLPEIIREDESGNISDKEEALKVFDKFSTYFTGFHENRKNLYSDEAKATAISNRIVNENFPKFFANVQVFKKLEKDFPQIVSDTEKSLAKHLRGKKLFDIFNPEGFNAVLSQSGIDFYNTVIGGVSGEAGSEKTKGLNEHINLVRQQLQDEQKKNLRGKMTVLFKQILSDRESASFIPVGFEASREVYESVKTFKENVLDKVISDTKDLFAQSKDFNLEQIFVPAKENTAFSQTLFGHWSVLREGAIAIERKKSQKELSSAKEEKLAKEIEKKDFSLAEIQRLYESYCAENDKEDKSRLVSVCDYFAFRGTSDNEPKELNLLEQISESYKKINFAEQKDLQQEKEAATPIKDFLDSAQNLYHYLKLVDYKGEEEKDSAFYARYSEILESLAEVIPLYNKTRNFVTKKPGEVKKIKLNFDCSSFLSGWGTEFGTKESHIFIDENKYYLGIVNSKLDKNDVANLKSKTGNTVKWVIYDFQKPDNKNTPRLFIRSKGDSYAPAVSKYHLPIESIIDIYDKGLFKTEYRNINQSVYKDSLVKMIDYFKLGFSRHDSYKHYNFCWKDSDKYNDISEFYSDTIKSCYQIKFENVSKDILLELVNQGKLFLFQIYNKDFSEKSDGEKNLHTLYFENLFSEENLKDVVLELNGKAELFFRPANDRLKIHVHKKDSILVNRTASDGSTIPEELYQEIYQFKNGFASSLSDKAKELLDSGKVVCKKASHDIIKDRHFTKNTYLFHCPITMNFKAAEITGKKFNTRVLEYLKDNPDVKIIGLDRGERHLIYLSLINQKGEIEMQKTLNIVNQVRNGKTVSVNYQEKLVQKEGERGTARKNWQTIGNIKELKEGYLSNIVHEIASLMVQHNAIVVMEDLNFGFKRGRFAVERQVYQKFEQMLIDKLNYLVFKDRGVSEAGGVLNAYQLTDKFTAFKDLGKQCGWLFYIPAGYTSKIDPKTGFANLFVTKGLTNVEKKKDFFDRFDSIRYDSKTDGFVFAFDYDNFGANALHDKDFQKKWEVNTRGERIVFSKTDRKSVSVSPTEELKIIFDTFGIKWNSGENFIDSVQEIQAEKANAKFFDTLLRSFNATLQMRNSIPNSEIDYLVSPVVASDGTFFDSREQKALEENGIAKLPVDADANGAYHIALKGLYLLKNSFNLNDKDYIENIKDADWFKFAQEKKYAE

SEQ ID NO: 413 - protein, 1327 aa, unidentified
MRNLNQFVGIYPMSKTLRFQLKPIGRTIENIEKNGILERDNKRAVGYKSLKKVIDEYHKAFIEQMLDDFELNLPDNENLDSLEEYYALYHQPSSTPKKKENITKVQDSMRRMISERFTKSEQYKRLFGKELIREDLAQFVTTPRFEAYIRSQKGNENLSDDEVHQIQDEIVQEISQFKEFTTYFSGFYENRKNMYVSDDKSTSIANRMIMENLPKFIDNMDVFERIKESEIASHFDTLYKEMEEYLNVNSIPEMFQLDYFSTVLTQKQIDVYNAIIGGKTLKDGTKIQGLNEYVNLYNQHQKDKSNRLPKLKPLFKQILSERNAISWLPEEFANDNEMLENIEQCYQNLREKVFEGENSLKKLLKEIADYDLEHIYLSDDIQLTNIAQKQYGNWGVIKKAFEESIMAENPKRRNETADKYENRIEKLMKANEYFSLAQINRLMKNHQGEEVIPIETYFATMGAENTENSQKPNIFIRIENAHTEAMTLLTTSYPEDRNLSQDKDNVEKVKKLLDAIKDLQHFVKPLLGNGAEGEKDSQFYGEFTPLWEILDQITPIYNMVRNRMTQKAYSDEKIKLFFDNNGSFLNGWVDSKTESDNATQYGGYLFRKQNSIGEYDYYLGVSANTKLFRSFNPVEVYDRSCFERLDYYQLKGKTFYGSLYKGDYEKESANIKQAIDNVVYHAGSKLLKERINAERAKKQSKVATATGYLNFVKQIEPELYDKLLQDELFEKGNQAIITSIRVTLQSLDRIPSAKEYAHKNYTLFSEMMDDVEIMLQGKVFSYFPVSQRELDDAIDRTTKPLYLFKITNKDLSFAETHAKGLRKSRGTDNLHTMYFKALMNGNQDVLDIGSGSIFFRKHKIVYTEEQLQRGHHHEMLKDKFSYPIISKRRYAFDKFQLHLSVTMNYNSDKNKDINPIVNAYLKESNATHIIGIDRGERHLLYLSLIDLHGNIVEQYSLNEIVNEYKGNTYSTNYRDLLDAKEKQRDEARRSWQTIENIKDLKEGYMSQVIHKIANLMVKYNAIVVLEDLNLGFMRGRQKVEKQVYQKFEKMLIDKLNYLVDKRLEFNDLGGVLKAYQLTNTEKMFSQQYRNNKNTLGKQCGFLYYIPAWNTSKMDPTTGFVNLLDTRYENMAKAKAFFAKFRSIRYNAIKGWFEFTFDYDDFTTKASGTRTKWTLCTYGTRIETKRDPKQNNNFTSEEFDLTDRFKEFLAKYHIDFGGNLMEQICSQDDVTFFKELLHLLHLTLQMRNSITGTDVDYLISPVINANGDFYDSRKCGKNLPQNADANGAYNIARKGLWIIEQIKQSKDLSKLKLAIGNKDWLRYAQRLT

SEQ ID NO: 414 - protein, 1300 aa, unidentified
MKMNEEFCGQKNGYSRSITLRNKLIPIGKTEENINQFLENDIERSMAYPEVKKLIDDIHRSFIQDTLSKVTFPWEPLFDEFELYQNEKDKLKKASHKKELEKLQTVARKRIVEAFKKNPDFDKLFKDGLFKELLPALIKNSTDKEITDKKEAVEVFNRFSTYFTGFHQNRQNMYSEDPKSTAISYRIVNENFPKFFANVKLFNYLQENFPQIIKDTETSLKLHLNGKTLSQIFNIEAFNDVLTQTGIDFYNTVIGGISGEAGSEKVQGLNEKINLAKQQLPKEEQNKLRGKMTVLYKQILSDRETSSFIPVGFENNNEVYDTVKQFNDETYSNVVEKIKELINICSDYDISQIFVPAKELTAFSLSIFGNWSILSEGLFLLEKDKSTKNLTEKQIEAINKEIEKKDYSLVELQTAYERWCTENTIPVTKTVRNFFAIKPLKNQKDSPDKTESDILQNIKSKYAIIDFENQHDLQQEKDAATPIKDYLDEVQELYHHLKLVDYRGEEQKDTNFYSKLDEVLQKLSEIVPLYNKVRNYVTKKPGEVKKVKLNFDCSSFLNGWGTEFGTKDTHLFIIDGKYYLGIIDKKLSKDEITGLQNTVNNSCKHIIYDFQKPDNKNTPRLFIRSKGESYAPAVSKYNLPIESIIDIYDKGMFKTEYRDKNPQEYRKALIQIIEYFKLGFSKHESYKNYDFCWKEADEYNDIAEFYSDVIKSCYKLDFENINYEKLLSLVDSGKLFLFQIYNKDFAEKSSGKKNLHTLYWENLFSEENLKDICLKLNGEAELFWRKASLDSEKVTHHKKGSILVNRTTKDGKSIPEEIYQEIYQYKNKMISSVSDETKKLLDSGTVVFKEATHEITKDKHFTEDTYLFHCPITMNFKAPEITGRKFNDKVLEYLSKNPDVKIIGLDRGERHLLYLSLINQKGEIEMQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKGVTEPGGVLNAYQLTDKSANVSDVYKQCGWLFYIPAAYTSKIDPKTGFSNLFITKGLTNVEKKKEFFDKFDSIRYDNKEDCFVFGFDYSKLCDNADYNKKWEVYTKGERLVYSKAERTNITVNPTAELKKVFEEFNINWKSEDNFIDSLQTIQAEKTNIKFFDTLLRSFNATLQMRNSIPNSEIDYLISPVKADDGTFFDSREQLALGKEAKLPIDADANGAYHIALKGLYLLQNDFNRNEKGVIQNISNADWFRFVQEKEYQK

SEQ ID NO: 415 - protein, 1252 aa, unidentified
MRKIEQFTGKYKVSKTLRFSLIPQGKTEEYIHVREYIEEDEQRAKDYARLKELIDEYHIRLIDEVLSVVRLPELEKYRALYEKTSRSDTEEKSKQELEQTYRTLLSGEKGGAFSANENYRRLFGKEMLTELLPPQLEREEDKAIVAGFSSFYTYLYGFNDNRKNVYSKEAIPTAIGNRCVQENLPRFLDNLSAFEKVKTGLRREVIDQLRDLLREKEIDLDGLFRLEGFNGVLTQRGIDRYNTALGGYTGAERKSIRGMNELINEHNQSCAREDRLPKLKPLYKMILSERKSYSWIPEEFKTDEEVYAAVGKCFAGDGDGLGLLTVRDKLYRLFADLEQYDQAGIYLDQAGVRAYSSGACGAWSDIRDAWFARYDLKLSGKKRPKDYEDKREKAWNKETCFSLRETAELAEEVACAQEREISSPADFWKEKVVSAAAALQERYAEAEPLLKTAPEGLRTKNETVIGPLKALLDGVKTLEGQIRPFVGTEKGSRGDAEFYGELLPLWDILWEFDRLYDRVRNYVTQKPYSQEKFKLNFRNPQFLKSWPENKEKDYMAIILREAGVYYLGVMNEKARGAFADYPKPIDESDCFEKMHYQQMADPSKDVQNLMVDETGKTVCRKGRKEKTGEHQGENLQLEEYKNKYLPDNINRIRKSKSYSVSNEKFNPSDLAEFIDYYKERVCEYLQGTTFVFRESRDYASFKDFTDDIDRQAYQLSFEPISRKYIESLVNEGKLYLFQIYNKDFSAYSKGKPNLHTLYFRMLFDERNLADTVFKLSGGAELFYRKASLKEKITHPSGQPIPNKDTYRAAQKPESVFPYDLIKDKRYTRPQYSLHISIELNTQAPSKPFKLDEEVREALAADPETRIIGIDRGERNLLYICVIDGQGRILEQRSLNALGQKNGFPVDYQAKLVRWEKENEEARKNWSTIQGIKELKEGYLSQVIHELCLLIEKYDAVIALEDLNPGFKNSRKKVERQVYQKFENALIDKLSFLTDKGEEPDAPGGLLHAYQLAAKPQHVGERRLQNGFVLYVDPGFTSKIDPVTGFVDLLYPRYTSVAAALELIGKLEGIRYVPEEDLFAIEVDYGKFDGTASSPRKKWTLWSYGKRVHSYRDQKSGQWSWEEIDLTGEFRRFFDHYGIDISGDIRQQLLDRPEKEVLEGFLHLFRLMLQMRNSIPNGQEDDLVSPVRDESGRFFDTRTLPKNSGLPENADANGAYNIARKALLMLREMREDPKHRFKGVKREDWMRYVQSHE

SEQ ID NO: 416 - protein, 1307 aa, unidentified
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYENRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSNPTLADGWDENKEQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 417 - protein, 1368 aa, unidentified
MNKTINDFTDLYSLSKTLRFELKPVGQTLENIKNGHFLELDKKKADDYQDVKKIIDNYHKFFIDDVLKNASLDWNRLEDATSEYNKNKNDDSKLLAEQKRLREEILKLFTSDKRFKALTAPTPKYLFNSILPDWFGETATPDLNKAALETFQKFTSYFKGFQENIKNVYSADAIPTAVPYRIVNDNFPKFLQNISIFKTIQEKCPQVIDDVENELCRYLGQEKLSDIFTLESFNKYLGQGGKEVQRGIDFYNQIIGGIAEKEGGVNLRGINQFLNLYWQQHPDFAKENRRLKMVPLYKQILSDRSSLSFKIASIANDEELKNALLECADKLESKNEEGKTVFDETCDLFASLKNQNLSGIYVNRKDINVVSRILTGDWSWLQSRMNAYAEEKFTTKAEKAHWQKSLDDEGENKSKGFYSLAELNELLEYASENVAETNIRISDYFEHRCRFYVDKESERFIQGSELVALSIKEMCDDIQTKRKGMNRVLENLSDEKQLREKSDDVAVIKDYLDAVQDLLHRIKPIKVNGAGDSSFYSIYDSIYSALSEVISVYNKTRNYITKKAASPEKYKLNFDNPTLADGWDLNKEQANTSVLLRKDGMYYLGIMNPKNKPKFAEKYEVTDGQSCYEKMIYKQFDATKQIPKCSTQKKEVQKYFLSGATEPYILNDKKSFKSELIITKDIWFMNNHVWDGEKFVPKRDNETRPKKFQIGYFKQTGDFDGYKNALSKWISFCKEFLQSYISSTVYDYNFKKSDEYEGLDDFYNYLNATCYKLTFINIPSSEIEKMVSEGKLYLFQIYNKDFAPGASGIPNMHTLYWKNLFSDENLKNVCLKLNGEAELFYRRAEIKDPVVHKEGSYLVNRTTEDGESIPEKIYLEIYKNANGKLNNLSKEASEYKESHKVVIKQASHEIIKDRHYTEPKFLFHVPLTINFKASGNSYSINENVRRFLKNNPDVNIIGLDRGERHLIYLSLINQKGEIIKQFTFNDVERQKNGKTIKVNYHEKLDQREKERDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGILFYVSAAYTSKIDPKTGFVSMMNFKDLTNVHKKRDFFSKFEDIHFDEATGSFVFTFDYKNFDGKAKEEMKQTKWAVYSREKRIVYFAKTKSYEDIMPTEKLEALFESAGIEYKSGNNIHDSVMAVGADLKEGAKPSKEIADFWDGLLYNFKLILQMRNSNAKTGEDYIISPVIAGDGTFFDSREETKKGKEAKLPVDADANGAYHIALKGLSLINKINLADEDELKKFDMKISNADWFKFAQEKKYAE

SEQ ID NO: 418 - protein, 1330 aa, unidentified
MATIENFCGQGNGYSVSKTLRFELIPMEKTLENISKGKFLESDKKKSDDYKDVKKIIDNYHRYFIDDVLKLASFNWVDLAKEINEYSKTKSDDTNLLSAQQKQREEILKVFNSDKRFKSLTASTPKELFNNLLPEWFEKDNSLELKKEAIETFKKFTSYFTGFQDNRKNVYKAEEIPTAVPYRIVNDNFPKFLSNISVFETIQKKCPEVIAEVENELKDYLGNEKLSDIFTIQFFNKYLCQSGAAKQRGIDFYNQIIGGIVEKDKEQNLRGINQFLNLYWQQHPEFAKNNKRIKMVPLFKQILSDRTTLSFKIESIDSDEELKLAILDCANKLEEKSKEDGKSIFEKCCELFDSINEQDLNEIYINRKDINNFSRILTGDWAWLQTRMNYYAEEKFTTKAEKTRWVKALEDEGENKSKGFYTLAELNDVLKYSSDNIPETNIRITDYFGHRYRYFYEKETGNYIPSEELVALSIEEMCDDILLKRKNMDKAFETSEKEKLQEDSETVSKIKDYLDLLQELLHRVKPLKVNGVGESSFYANFDTIYSALKEVISVYNKTRNYLTKKAATPEKYKLNFDCPTLAKGWDANQESSNDAFLMRKEGKYYLGIFNPKNKPKFLEKYEINNEDCYEKVIYKQMALPMGLGAFVRKCFGTAQKYGWVCPKNCLNSEGKIIIKDEEAKENLEAIINCYKDFLDKYEKDGFKYKNYNFNFLDSASYKKLSEFFKDVEPQGYKLSFTNIPVSEIEKMVEDGKLYLFQIYNKDFSPESKGTPNMHTLYWKNLFSEENLKDVCLKLNGEAELFYRPVGIKNPIVHKKDSYLVNKLTKDGKSIPESIYEEIYKNANGKLDKLSKDAEEYKNTHDVVIKVAKHDIIKDKHYTVPKFLFHVPITINFKASGNSYSLNENVRKFLKNNPDVNIIGLDRGERHLIYLSLINQNGEILDQFSFNTVEQSRNDAEPRKIDYHEKLNQREKERDEARKSWQTIGKIAELKEGYLSAVIHKLAQLMIKHNAIIVMEDLNFGFKRGRFHVEKQVYQKFEHMLIDKLNYLVFKDKDLTEAGGVLNGYQLANQFESFQKLGKQSGMLFYVPAGYTSKIDPKTGFVNMFNFKDLTNVHKKRDFFSKFESISFDNDTDSFVFTFDYKNFDGKAKEEMFISKWSVYSREKRIVYYSKTKSYEDVLITEKLKSAFQKVNIDYTNGNDLLDSIMEIGADLKNGEKPSKEVADFWDGLLYNFKLILQMRNSNARTEEDYIISPVKAPDGTFFDSREEGKKEHNATLPKDADANGAYHIALKGLSLLKRFDVADEKSLKKFDMRISNADWFKFVQEKNYEK

SEQ ID NO: 419 - protein, 1297 aa, unidentified
MTTLAAFTKQYQVQKTLRFELIPQGKTQENIDARGFINEDLQRDENYEKVKILIDDVHKKFIEKTLRKVNYSWNELAVAVTNYRRDKSDNNKKNLTKEQEKARKEIIGWFTGKCGSTSFKKAQKEYFEKLFKEKLFKEILRDETLGFNADIIAAIDGFDRFTTYFVGFHENRKNMYSSDEKSTSIAYRLVNENFPKFLSNCEAFTTLVNVCPDVIAEAEQELREHEAFNNIVLADVFTIDSYNAFLSQRRIDYYNQIIGGVSATEGSRKIRGINEVINNAIQQNAELKVLLRNKQFTMTQLFKQILSDRESMSFVAEQFDDDQEALEAVKCYNAEIISNKTLDVIKKLFENFRYYDLSKIYISAKELSNVSVLLFKQWNKIRDVVYDAKKATLGDNPSKAKLALLDKELKTKDFSITELSAYEDSFVNKEGGVCPICNIVNVVLDAVDMLQELTHGELPENLQTFDNKNKVKSILDAYENLLHILNCFKVSADNDIDLAFYGDFDKVYCYLSKVMPLYNKVRNYSTKKPYSVGKFKLNFAMPTLATGWDKNKERENGSIILLKDGQYYLGIMNPQDKPNIDECINADDNGYQKMIYKMFPDIAKMLPKCTTQLNPVKEHFTVSEDDFVLSDNSKFESDLVITKEIYNLNNVTYDDKKKFQIDYLRNTGDVVGYHQALKTWIDFAKDFLSKYKSTAIYDFSTLLSSDMYERIDLFYADVGNICYKISYENISVEQVDEWVNNGKLYLFKIYNKDFAPGATGRPNLHTLYWKAIFEDENLQDVVIKLNGGAELFYRSKSNIPKIAHKVGEKLVNRKDINGIPIADSVYKELYAWANGKIKEEELSASAKEAKAFAVIKDVKHEIIKDRRFLSDKYFFHVPITLNYKASSNPSGFNIQVQNFLRNNPDVNIIGIDRGERNLLYVVAIDQKGNIIERKQISYNKVNGYDYYEKLNQREKERTEARQAWDIVGKIKELKEGYLSLVIREIADMMVKYNAIVVMENLNVGFKRIRSGLAEKAVYQKFEKMLIDKLNYLVFKDAEAGAVGGVLNAYQLTDKFDSFEKLGNQSGLLFYVPAAYTSKIDPLTGFANVFSTKHITNTEAKKEFICNFDSLVYDEEKDKFILDCNLDNFKVVATSFLKSWKFIIGGKRIVYNSKDKTYITKYPCEDLKTALITYGIDYSQSDLLDVLDSKPADREHSKLFNSVYWAIMNTLQMRNSNAATGEDYIISAVANETGKVFDSRTCGDELPKDADANGAYHIALKGLYLLQQINAVGENERVDLGIKNEDWFKFVQTKEYVK

SEQ ID NO: 420 - protein, 1346 aa, unidentified
METIDSFCGQKNGYSISKTLRFELKPVGQTLESIKNGKFLESDKKKADDYQDVKKIIDNYHNFFIDDVLKSASFDWRQLEKSIHEYNKNKTDDSEFVKEQDKLRKGIADLFSKDKRYKSLTASTPSDLFNKDKDFIDWLAQTSVKEIRKDALETFKRFSSYFTGFQENRKNVYKSDLIPTAVPYRIVNDNFPKFLQNISIFKTIQKKCPQVIDDVENELCRYLGQEKLSDIFRLESFNKFLGQSGKEVQRGIDFYNQIIGGIAEKEGGVNLRGINQFLNLYWQQHPDFAKENRRVKMVPLYKQILSDRSSLSFKIESIANDEELKNALLECADKLESQNEEGKSVFDETCDLFASLKNQNLSGIYINRKDINAVSRILTGDWSWLQSRMNAYAKEKFTTKAEKARWQKSLDDEGENKSKGFYSLAELNELLEYVSENVAETNIRISDYFDHRCRYYVDKETEKFVQGSELVALSIKEMCDSILAKRKSMNGVLENLSDEKLLQEKPEDVAVIKDYLDAVQELLHRIKPLKVNGVGDAAFYSVFDSIYSALSEVISVYNKTRNYITKKAASPEKYKLNFESPTCANGWALNNELMYGCILLRKQDKYYLGIMNKDEHKFFKKYPLAKPRDDFFEKMIYLQAADPSKDVPNLMVINGKTVKKNGRKDSDGVNRQLEELRNTYLPENINKIRKSKSYLKSSETFSKEDLTEYIEYYKERAIDYFNSYKFFFKNSADYTSFVEFTDDINAQAYQIQFVKITTSFITQMVNGGKLFLFQIYNKDFSEKSNGKKNLHTLYFENLFSEENLKNTVLKLSAGAELFYRPAGIKEPTVHAKGSYLVNRTTEDGEAIPENIYLEIYKNANGKLESLSDEAKAYKESHKVVIKKAGHEIIKDRHYTEPKFLFHVPLTINFKASGNSYSINENVRRFLKNNPDVNIIGLDRGERHLIYLSLINQKGEIIKQFTFNDVEREQNGQIVKVNYHEKLDQREKVRDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGMLFYVPAGYTSKIDPKTGFVSMMNFKDLTNVHKKRDFFAKFDDIHFDNATGSFVFTFDYKNFDGKAKEEMKQTKWSVYSRDKRIVYFSKTKSYEDIMPTEKLRALFESAGIEYKSSNDILDSIMAVGADLKDGAKPSREIADFWDGLLYNFKLILQMRNSNAKTSEDYIISPVMASDGTFFDSREEFDKGKDAKLPLDADANGAYHIALKGLSLIKKINLSKDAELKKFDMKISNADWFKFVQQKEYTK

SEQ ID NO: 421 - protein, 1200 aa, unidentified
LIDNYHKECIHESLHNVHLDWLPLKEAIVTHRKENTEDTKKRLEKEQESMRKKIASAIKDFRHYKELTAPTPKDLINKVFPRIYNDEALKSFNRFALYFKGFQENRNNIYSPEAISTGVPYRLVHDNFPKFLADIEVYENIKAVCPEVLGQVSTEMSPFLEGVMIDDIFRLDFYNSLLTQDGIDFFNQVIGGVSEKGKQKYRGVNEFANLYRQKHPELGNMKKALTMIPLFKQILSDRETLSYIPQQIESEQQLEDAINQFYTHITNYQRDGKTLNVLNELAKLTADIGSFTPEGIFISSKYLTDVSQRVFGHWGVINDKLTEYAIKKFGSIEKAKNKKKVESYLNKDAFSLSELCFDEDKSLSPYFSDLLDRTNLIHSNWLQYKEWCKGESKQLFLNNEDGTEIVKNLLDSIMEFLHRCEVLVVSVDNDLDNDFYNKFLPLYAELENVILLYNRVRNFITKKPSDIKKIKLNFDRPTLGDGWGLANEKKNKAILLFKDGLSYLGIMNVKGTLNFADARTDGEPTYKKMVCKNLSKPFMDFPHTFFSQKGKDTFLPSDNVLAIYTSGSFKKDSPSYTAENLYELINFYKEAINKHEEWREFGFVFSPTESYTDIGAFYNEVAKQAYKISFVEVSEQKVNDWVEKGELYLFKLHNKDYAEGAHGRKNLHTLYWENLFSSENLSNFVLKLNGQAELFYRPQSIKKSVVHKIGSKMVNRRDISGMPIPESVYRNLYLYFNGKKQEAELTEVEKSYLNQVVVKEVSHDITKDRRYTQPEFFFHVPISFNQNADGNEFINTKVLDYINNNPDVNIIGIDRGERHLIYLTLINQRGDILKQKTFNMVANFNYHAKLEQREQERDQARKSWKSVGKIKELKEGFLSAVIHEIAKMMIDNNAIVVLEDLNFGFKRGRFKVERQVYQKFEKMLIDKLNYLAFKDCRVMDDGGILRGYQLSQKFTSFQKLGKQSGFLFYIPAAYTSKIDPTSGFVNLFNFNDITNVEKRKDFFMRMNRIEMKSGEVEFEFDYRKFKTFQTDYQNVWTINTYGKRIVMQLDEMGHKKMEDFYPTCHIINAFKKKGITISDGIDIKAILSAIEANAANASFYSALFYAFQKTLQMRNSNAITEEDYILSPVAVDGRHFFSIDEANKGRDASGNWISNLPVDADANGAYHIALKGLYLLMNPLTKKIENKKWFQFMIEKPYRS

SEQ ID NO: 422 - protein, 1332 aa, unidentified
MRAIEQFCGQSNGYSRSITLRNRLIPVGTTERNIKEFLDKDIECSVAYPEIKKLIDGLHRNFIEECLSGVSFPWEPLFDEFELYQNERDKAKKIERKKNLEPLQKAARKRIVKAFISNKDFEKLFKEDLFKELLPALIKNSPDSEIADKEKALIIFRRFSTYFTGFHENRKNMYSEEEKSTAIAYRIVNENFPKFFANVKYFDYLNKNFPEIIKDTEISLKDYLKDRKLKDIFNVEAFNKVLSQSGIDFYNTVIGGISGEAGNQKIQGLNEKINLARQQLPKDEKDKLRGKMVVLFKQILSDRETASFIPAGFEKNEEVYSAIKEFNEKIVNDSIAKTKELFSQKFEFNYNEIFVPAKSITAFSLSVFGNWSIISEGLFLLEKDKSKKALTEKQEEQIRKDIAKKDCSLGEIQTAYERYCQENGIEDQIATIKYFDLTEMSSDSSEKVEVSILDQISKSFNRIDFENTKDLQQEKDSAIPIKAYLDEVQNLYHHLKLVDYRGEEQKDSNFYSKFDEIVESLSEIVPLYNKVRNFVTKKPGEVKKVKLNFDNVSLVKGWDVNKESDYTCIMLRKSGLYYLGILNPKNKPKFEAENEGKILVDKNNSYEKLIYKYFKDVTTMIPKCSTQLNEVKKHFKESDEDYILANDNFIKPLVISKRIFDLNNQTFDEKKMFQIDYLRNTGDTKGYSEAVKDWIAFCMTFVKSYKSTSIYDFSSLGDCSQFRQVDCFYKEINLLLYKIWFVSVSCDKINSLIEQGKLFLFQIYNKDFAENATGKKNLHTLYWENLFSEENLKDFCFKLNGEAELFWRKASLDKNKVTIHKKESILVNRTMSDGSTIPENVYQEIYQYKNNINSSMSKEAKELLDSGRVVCKKATHDIIKDRHFTDDTYLFHCPITMNFKAPEITGKKFNNKVLEVLKDNPETKIIGLDRGERHLIYLSLINQKGEIELQKTLNLVEQVRNDTTGKINYQEKLVQKEGDRDKARKNWQTIGNIKELKEGYLSAVIHEITKLMIENNAIVVMEDLNFGFKRGRFAVERQIYQKFENMLIEKLNYLVFKDRPVTEPGGVLNAYQLTDKAANVSDVYKQCGWLFYIPAGYTSKIDPKTGFANLFVTKGLTNVEKKKDFFLKFDSIHYDSKEDCFVLAFDYSKIGDNADFKKKWQIFTKGERLIYSKQERKTIAVSPTEELKKVFTGFGINWENGGDILESIKTVPAEKQNAKFFDILLRSLNATLQMRNSKPNSSNQEDDYLISPVKADDGTFYDSRVEAEKGEDNEGNWISKLPVDADANGAYHIALKGLYLLQNDFNRNDKGTIQNISNADWFKFVQNKEYRN

SEQ ID NO: 423 - protein, 1245 aa, unidentified
MKDLKQFIDLYPVSKTLRFELRPVGRTQEWIEKNHVLENDGKRAEDYPRVKDMIDTYHKTCINESLDDVVLDWTPLRDAIERNRQEKSDESKKALEEEQTKMRKKICEKLASFKHYQELVKADTPSKLISGILPHDKTLDTFNKFAVYFEGFQENRRNIYSNKAISTSVAYRLVHDNFPKFLANIEVFENIRSICPDVINQVADEMAPFLEGVMIEDVFTVSYYNSVLTQNGIDYYNRILGGVAKDGQKYPGINELTNDYMQHHPELGAKRKSLTMVPLFKQILSDRETLSDIVKPIESEEQLIRVINNFYHHITNFTMNGNNVNVVKELTKMVLSLDQYNPDGIFVSAKALNELSHSLYGNWNRINEKLYDKAVEMVGDIQTAKNKKKVEAYLNKEAYSLSEISFNDGTSIFHCFSALINSADSINSLWLQFQNWCKTAERPQFVHNEVGTEFVKKLLDAIMLVLHKCGTLVVSLENNLDSDFYNKYLPFYAELENVILVYTRVRNFLTKKLSDTGKIKLKFDTPSLGAGWGINKEKTNKAILLFKDGLSYLGIMNVRGTLDFNCKIEVDEPTFKKMVCRNYSKPYMDLPNSFFSQNGINKYQPSERIQKIYLAFKQNSKNVDIKKVRELIDYYKDAISRHEDWGSFGFKYSPTESYETINDFYTEVAAQSYRLSFIDVPQKQVDEWVESGQLYLFQLFNKDYAEGAHGRKNLHTLYWESIFSEENLDNLFIKLGGQAELFYRPQSIKNPVSHKVGTKMLNRRGKDGKPIPDAIYRSLYQYFNGKKTEAELTAEEKAYISQTIVKDVHHEIIKDRRYTKQFFYQFHVPIVFNANAPKRPRVNERVLEYIKENPDVNIIGIDRGERHLIYLSLINQRGEILKQKTFNVVGDYDYQEKLKQRENERDQAQKSWQSVGKIKDLKEGFLSAVVHEIAKMIIEYNAIVVLEDLNRGFKRGRFKVERQVYQKFEKMLIDKLNYLSFKDVDIAVEGGILRGYQLTEEAKNYTDIGKQTGFLFYIPAAYTSKIDPVTGFVNHFNLNDITNAEKRKDFFMKMERIEMKDGNIEFEFDYRKFKTYQTDFQNVWTVNTSGKRIVFDTDTRKAKDVHPTKEIVQAFANKGITLEDGMDIKALIEGIGCDAKNASLFSSLLYAFKTTLQMRNSNADTKEDYIHSPIVRDGKQFCTTDEMEKGKDADGNWISRLPVDADANGAYHIALKGLYLLLKPQVKKIENEKWLQFMYEKEYRK

SEQ ID NO: 424 - protein, 1245 aa, unidentified
MKDLKQFIGLYPVSKTLRFELRPVGRTQEWMEKNHVLENDEKRAEDYPRVKELIDAYHKQCISESLKDVALDWTPLRDAIERNRQEKSDESKAALEEEQTKMRIEICKKLSSFKHYKELVKADTPSKLISDILPHEEALDTFNKFAVYFEGFQENRRNIYSTEAISTSIAYRLVHDNFPKFLTDIEVFEGIKAICPDVINLVADEMAPFLEGVMIEDVFTISYYNSTLTQNGIEFFNQILGGVAKDGQKYRGINELTNEHMQHHPELGAKKKSLTMVPLFKQILSDRETLSDIAKPIESEEQLIKVIDNFYYRLTNFTTNGNTVNLVKELTDLVLNLNQYNSNGIFISAKTLNEVSHSLYGQWNRLNEMLYDKAVEMVGDIQTVKNKKKVEAYMDKDAYSLSEISFDDGVSINQYFSALTNSAESINSLWLQFQNWCKLAEKPQFVHNVAGTEIVKKLLDAIMQVLHKCGTLVVSLDNDLDSDFYNKFLPLYAELENVILVYTRVRNFLTKKLSDTGKIKLKFDTPSLGAGWGINKERKNKAILLFKGGLSYLGIMNVKGTLDFKCRVQDGEPTFKKMVCRNYSKPYMDLPNSFFRQNGIEKFHPSERILKIYEAFKKDSKSVDINEVHELIDYYKDAISRHEDWGSFNFKYSPTVSYQTINDFYTEVAEQSYKVSFIDIPEKQVDEWVEAGQLYLFQLYNKDYAEGAHGRKNLHTLYWESIFTEENLNHLVVKLGGQAELFYRPQSIKKPVSHKVGTKMLNRRDKNGKPIPDTIYRSLYQYFNGKKTEAELTTEERAYVNQVVVKDVHHEIIKDRRYTKQFFYQFHVPIVFNANAPKRPKINERVLEYIKENPDVNIIGIDRGERHLVYLTLINQHGEILKQKTFNVVGGYDYQEKLKQRENERDLARKSWQSVGKIKDLKEGFLSAVVHEIAKMMIENNAIVVLEDLNRGFKRGRFKVERQVYQKFEKMLIDKLNYLSFKDVAMTEEGGILRGYQLAEQVTNYTDIGKQTGFLFYIPAAYTSKIDPTTGFVNHFNFNDITNAEKRKDFFMQMERIEMKHGNIEFEFDYRKFKTYQTDFQNVWTVNTSGKRIVFDAETRKAKDVFPTTEIVQAFANKGFTLEEGTDIKALIEGIDADAKNASLFSSLFYAFKYALQMRNSNAETKEDYILSPVVRDGKQFCTIDEVEKGKDADGNWISKLPVDADANGAYHIALKGLYLLINPQTKRIENEKWLQFMVEKPYKD

SEQ ID NO: 425 - protein, 1334 aa, unidentified
MRTIDEFCGQKNGYSLSKTLRNKLIPVGKTEDKIKEYHLMENDYGRAAAYVEVKNLIDDFHRSFIAERLDKVSLDWTNLFNALNEYQKNQKDKLLKAKCKKVLEAQQKEMRKKIVQLFTGDKDNKDPVYEKLFKKELIEDLLPEAIKKDTSGIITQKEEALAKFHQFCTYFTNFHENRKTIYSAEDKSTAISNRIVNENFPKYVANIKVFEYLSKNFPKIIDDTENQLKNDLSGKKLKDIFTINGFNNVLSQKGIDFYNIIIGGIPEKEGIPRKQGINEAINLLRQGLPPERKNELKQRMTFLYKQILSDKEKVSFIPEVFNDSKEVYLAVQAFNAKCISSIIDKIADLYKQHNAYNLEKIFVPAKSLTAFSQSVYGNWSLLSECIFEKEKGEKTLSEKKLEDLTKKIAKNDYSLIDLQSAYDIWADKNNIEFNKRISINSYFNLNEIRQQKKPDGTYEKVVSNLIEDVKSTYIRIDFDNIKDLQQEKNASIPIKEYLDAVQNLFHYLKLVDYKGDALKDEMFYSSYDEYLQILSEIMSLYNKTRNFVTKKVGEIKKIKLNFDCSSLLSGWGTDYGSKAAHIFKSDSCFYLGIINKKLDKTDIDSIYQNGNTMIEKIVYDFQKPDNKNTPRLFIRSKGTAYAPAVSTYDLPIESVIDIYDKGLFKTEYREKNLEVYKKSLIKLIDYFKLGFSRHDSYKHYNFCWKETKDYADISEFYADTMRSCYQLKTERINFDNLMTLVDEGKLFLFQIYNKDFSTGKDGGNGSTGRKNMHTLYWENLFSKENLDDVVLQLSGGAELFFRPKSLEEENATIHEKNSFIVNRTYLKEVKGNKEIYETIPEEIYQEIYQKLNGKTDTISDEAQELLSSGKVKYRAAPHRIIKDRHFTQDTYLFHCPISLNFKAQEITGKKFNDRVLEKIKNNSEIKIIGLDRGERNLIYLSLINQKGEIELQKTLNLVEQQKRLIDYQGKLVQKEGDRDKARKNWQTIGNIKELKEGYLSAVVHEIATLMVDNNAIVVMEDLNFGFKRGRFAVERQVYQKFEHMFIDKLNYLVFKDRKVTEPGGVLNAYQLTDKLEAFKDLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENLTEEFKTLFREFDYQNGNNILDSILEVGAALKAGEKPAKEIADFWDKLLVLFKLVLQMRNSDAKTGDDYIISPVMSESANFFDSREQEKLGNNAKLPKDADANGAYHIALKGLYLLKAFDKTPEDQLKKVDMKISNADWFRFAQENEYNK

SEQ ID NO: 426 - protein, 1044 aa, unidentified
EHISGMFSLDYFTDVLTQEQIEVYNSIIGGRVEEDVKLKGINEYVNLYNQQQKDRKNRLPLLKPLYKMILSDKVAISWLPEKFESDEEMIDAINEAINNLQPVLDSKNKNSLKYLLQHIGEYDLSRIYISNDLGLTDISQQMFGQYDVFTKGVKDDIRQHATPTKKERANAELYEERINKLFKLGKSFSIAYLNDISGKIQTIEEYFAGLGAYDRNGEQHINIFAQIEMARIAAVDILVGKHTNLNQSEADIKLIKDLLDSFKALQHFIKPLLGNGDEADKDNEFDAKLREAWNALDIITPLYNKVRNWLTRKPYNTEKIKLNFENPVLLEGWPKPEANSCVIFKENDSTYYLGVLENNHRTILRQCFSPINVDDIIFHMKYLQGGDMGKNVQNLMIKDGKVCKVNGRKETSGPFAGQNIRLEEYKSKYLPPEINRIRKQGTYSLTNANFRKEDLCAFIDFYKPLVIEYYSDYKFSFKESCKYNSFKDFTDHINQQSYQIQFLEFSRKELMRLVNDGKLYLFQIWNKDFSEYSKGTPNLHTLYWKMLFDERNLADVVYKLNGQAELFYRKKSLDLCKTTVHKAYQPIANKNPQNDKQESNFDYDIIKNRRYTVDKFQFHVPITINFKATGDGRINTATLEAIHDGKIKHIIGIDRGERHLLYLSLIDLKGNIVKQFTLNEIINEYKGLAYSTNYKDLLVAREGDREEARRNWQKIENIKEIKEGYLSQVVHIIAKMMVEYKAIVVLEDLNGGFMRGRQKIERQVYEKFEKMLIDKLNCYVDKQKDAEDTGGVLHPLQLTNKFESFRKLGKQSGWLFYIPAWNTSKIDPVTGFVNMLDTRYENADKARCFFSKFDVIRYNAEKDWFEFILDYSKFTDKANGTQTKWTLCTYGTRIKTFRNPKQNNQWDSEEVILTDEFKKVFAEAGIGITGNLKEAICSLTEKKYLESLMHLMKLLLQMRNSKTGTEVDYILSPVADANGNFYDSRKNIATLPKDADANGAYNIARKGLWAIRKIQSTPSGEKLNLAISNREWLQFAQQKPYLDE

SEQ ID NO: 427 - protein, 1328 aa, unidentified
MANIDVFTNKYRTTLTVKNELKPIGATLDYIKKQGFIVEDEKRNDDYKKAKVLIDAFHQKFINYVLNDVKELSWQELQDTTIALQKAQKNKMGVNEKDFASCKKAYNDVCKKTRKSIHNLFNKTDSVFSLKKIFEGNTDERFISPDSDVEFNYKDLFGKNLITSILPAVLSGENLDVINNFSSFTSYFSGFYDNRKNVYSPDEIPTSISYRIVHDNFPKFLTNIRVFNKIKELRPEIIKHCQESILKYLQKEKINCDLCVSNFDLSKVFNIDYFNKTLSQTGIDLYNLIIGGIPVDTGIEKIRGLNEEINLATQKDKSLKDILRNANALKFIPLFKQILSDREKSFKIEAYQDEKELISDLKEFFNNIYSQSILSNLEETFGGISDNNLLNIYVHGKNLSMLSIQCTNNGNWNFFQDAIETSNNSENKKKKRKNADSTSEVSSSIYSLGYLHELSSRIDNGEDLILGINNALKVMIKEASAYKNVDYPKGMTSKNDKERIKNQLDAFLKLYNFARIFDINESSLDKDVDFYSKYETVMSALGEIPSIYNKVRNFATKKPYSLDKFKLNFKNPKLATGWSLSKESDYQTVIFIKDDRYYLGILIDKKIPFTENESSSTVNVYKKMNYVLLPGAEKQLPRQCFTKAVKTHFMTSNEPFVLSNKIFSKDLIITKDIFDIYNNESYKQNADKSDLKKYIDFYLEFLQINNTTSRFDFSSLKNRDYDNFASFTNDVNEIAYMIEFSNFDVSFIDKLVSEGRLYLFQIYNKDFAKGTSGKKNLHTLYFESVFDPDNLKNVIFKLNGEAELFYRRASIKKDDVTVHATNSILVNRVDKDGRTIPEDIYLKLLRWVNGSANETWSNEELEYRSKIVTKTATHDITKDRRFTEDKFFFHCPITINFKAPKEFYYFNDRTLDFLRNNPDVNIIGIDRGERNLIYVTVIDQRGNILFSKSFNEISNVVSSSEKKHSVNYQQKLQQREKERIAEKKSWESITKIANLKDGYMSFVIHEIVELMVKYNAILVLENLNTGFKRIRQGIAEKSVYQKFEMALVSKLNYLVFKNKDKYEPGGILNGLQLCNKFTSYKDIGSQNGFVFYVPAQYTSKIDPLTGFCDVIKWGGIKNKADKKNLFNSFTEISYVKQEDMFRFSIDLNNVSKVVRLQGSCYRNIWDIYTYGERIIKKKVSNHANPRGFIEIKNYSPTEEMKNLLRNNNIDFSDGSNLKDILVNGNFDKWNELFDIFKNTLQMRNSISNEMEDYLLSPVKDSNGDFFDSRKHIPGQPADADANGAYHIALKGLMILQKNNKLSTNTKFNKTVSNQEWFEFVQKEDRFKV

SEQ ID NO: 428 - protein, 1238 aa, unidentified
MTVFDSLTGFFPLTKTLPVKLTPIGNTLHNMQVNEVIEADEQLLQKFTRLKQMADDYHREFIAKVLENFTLKLHSDGHDDSLEEYAEMFDSDRRNNEGNRFRFNIVKSCLRLAISKAFESAPEFRKLDKKELVSDILRSRVTGEDKDVVESFSKFTSYLVPYYKTRKLYGYDEKANTIAYRCIDDNLPVFYNNLKAFEKVRKTLPQEVFDKLNEDLRSYLDGNNIGEVFKLEYFNKCLTQKGIEKYNTVLGGYNTSETHIKGLKEYIYLYNMDQKEKKNMLPALSDLKKQILSDREVISWQDMKYEDSRKMYKDLIAFHQVYRKLVASPLRQLMTEISQYDSKGIFISNKDCISQISLALCGKWSAIREVIYIEFSRNIKRKKKESTEKYDKRVYQAIDGRESYSIAEIDSCLLEFDKKLADYYMKMGAVDNKVLQRENYFATIENAWTELQPMAVRFANAENSHQPKEDEVVKIKVYLDAVLQLYHFVLPLKGEGNELGRDAAFYEVLDSCMLELQNIVGLYNRIRSFITRKPFTTNKIKLNFGSPQLLSGWSSDNEAVHRSLLLQKDGRLFLVVLEKGQHNLFTDESDILKEGEDFYEKVEYNYFGDAAKQLPKRCFAACNIDLFRPSEEILQIRKRGSYLAGNNFNIDDLHKLIDYYKGCVMKMQKWCEVNFNWKDTSEYKSISEFVKSFTAAGYYINYQKVREQTVERLVNEGKIYLFRLDKKDYSPYSKGRKSLYTMYMDMLFHPANLEKVVYKLSGGAEMFYRKASVKSNRPTHPAGLPIANKNPEVAVHKPESVFAYDLIKDKRYTKDMMMVHLPVTVNYFAADSKGMPVTMQVRRLIREGQFKHIIGIRRGERNLIYVSVLDMNGKIVEQKPLNIIESTCGGQPYSKDYNALLQRKEEERLQSGKDWKTIDKIKDIKQGYLSQAISTITDMVLEYEALIVMEAINKQFKRSRQKIEKNIYAKFEQQLIDKLNFLVKKNRDMNEPGGLLNALQLTDKVEPGLDLFQNGIIFYTPAAYTANVCPVTGFVSLFNLKNGKIEEVKAFFSKFDSIRFNKETGLFDFTFDYNNFTDKAENARTCWTVSTFGQRCGCIESAGQKKRALVDLTKEFKNLFTRHGVDYTGNLKEAIATVNKRSFYDGLVELFNLMMQMRNIMGDNIDYLISPASDENGRYFLSSPENKEWPIDNDANTAYNVARKGLLMVQSILRTTEKEKVNLGITNERWMKYIQCIS

SEQ ID NO: 429 - protein, 1260 aa, unidentified
MKKLEQFTNLYPLSKTLRFRLIPVGKTQENIIKNRVLEEDLEKAENYKKAKVLIDQYHRYFIDDVLSNNSFDWNAYAEAIEHKGSKEEIDGIKADLRKQITSVFEEDKRFKTLFGEKFFSEILKKYYSDDDEALKILASFEGFTTYFVGFYENRRNIYKSDDIATSVTHRLVTENFPYFNGNIHAYKNAKKLIPEKLEFLEKNISEEFHEISFDELFSPNGFNHVLTQNGIEMYNTILGGYTKENKVKIQGINELVNEYGQKNPKDRSVSRMKMTMLYNQILSERISNSFVFDIYETDKDVIDAVEYLKRQYLNVYRAMMEEIFQTLHSDENVLVDNKEIRLMSQRLYGNYSTLESVMYDSFAKTVNNRKAPNKKQEEAYKKISSHTIKEINNAITIANEKNEKTCNLNEYYTRFTDILNFIDAEWKICLNSYNESMNLRSQYGTVENIKGVLDSLIETLKTIRCYDHQSADISNSYLTHAALNKYDNEVYEIYNKIRNYITKKPFSNEKIKLNFNNSQLASGWSVTKETDCRALILRKNGYFYLGILNTNHTVEEQPESTDGYEKMKYQYISGVNKMLPKCIFTKAVKAHFSGTEKNKDCKLFDKKKMIEPLLITPYDYQVYSEGRMKKEYLKNGSEKEYRRALTDWIELCQNMFKKYKSWLDFDLTNIKKPEEYESLDQFYKDLDNACYKVTFVNVSQEQIDCMVNDGTLYLFKIYNKDFAEGAHGSENLHTKYFKAIFSSHNLSTGIFQLNGGAELFWRKASLDNQITHKKNSYLINKVTSDGETIPANIYNELYRYYNNKCALSEAAQAYLSKAVVKKARFDISKDKRYKEDQFFFHVPIKINYKQRDVSRFNDMVNDYLKNNKDIRIIGIDRGERNLLYVNLLDRSGHILEQKSFNIVNECRYDGSVRKIDYLSKLELREKERDESRKSWQSIGTIKELKEGYLSSIIHEIAKMMIDNNAILVMENLNSGFKRGRMKFERQVYQKFEMMLINKLNLFALKSLKDEETGSIYHAYQLTNKLTAYSEVYNQTGFIFYVNAGFTSKVDPVTGFADVFYRAKMKEEYRNFVEKLDKFVYDEGTDMFMFSFSYSNYPVNVLPYHQKWDVYTNGKRIIHNNANGKHTYRTVDVTKELKNLLKEYGIVYKDNDLKKEICSMTDTREKNALQNKVLELFFETIQLRNSNPKTGEDYIISPVMDKDGKFFLSDVNDKSLPCDADANGAYNIARKGLMILKKIDEGKSSSDLKITNEEWFAYIQK

SEQ ID NO: 430 - protein, 1034 aa, unidentified
MIKEQIRKVRSCKLEELYKQILSDRSIISFRLNEIKNDGELCQLIQNLFRINFNNEIVCKKEIIDKETAEIIEEVNISEHLENSFRHISEADPDQLYIRNDRALTDISQAIFGNWSLIGNSLKFYAEKEELGKNKNGIPKKLTSKEQEMWLKHNYFSFGTIHKALQSYFNQFDANELDKEPSDAQNSANAITVETKELAENKPLFEYFKSFETSKKNKETNAFEKVSLLKSVKSAFQPALEMLKKYENEGGEKLKNEKTDVEKIKIYLDALMDLLHFLKPLYVELSRKEEMKAEVFEKDTGFYDDFDKAYNTLKQIIPLYNQTRNHLTKKPFSVEKYKLNFDNSTLAAGWDKNKETANTAVILIKDGKYFLAIMTKEYNKLFQTEPHINTAPAYKKMDYKLLPGASKMLPKVFFSNKNIDYYNPSKEVLHIRNHGTHTKNGRPQKGFTKQDFTKKDCHTMVNFYKNSISRHAEWKEFNFEFSQTNSYNTIDEFYREVEQKGYKITFSDISESYINQCVKEGKLYLFEIYSKDFSKHSKGKPNLQTLYWKEIFSERNLKNVVYKLNGEAELFFRKASIQYPDIVWKEGHHKNDPLKKQKYPIIKDRRYAKDTFLFHCPVTCNFKAQGIPRFNDKVNTFLKNNPDVNILGIDRGERHLAYWTLINQKREIIKQGSFNNPQGKKDYHDLLDIREKERDKARKSWSTIEKIKDLKAGYLSLLVHKIAKMVEEHNAIVVFEDLNFGFKRGRFKVEKQIYQKLEKALIDKLNYLVFKDKNTAEAGGVLNGLQLTAPFESFQKMGKQTGVVFYVPAYHTSKVCPATGFVNLLYPRYETIKKSQEFFKNFCEIKFNSQEDYFEFSFNYEKFTKKAEGSRQNWTLYTYGERLENYRNSLQNNQWDTREVKLTEAFKKLFNQYVIDFNDGTDIKDQIVRQTEGKFFRQLTHLLKLTLQLRNSRINSDEDWMISPVRGNNGTFFDSRKEDSKMPENADANGAYHIGLKGLWVLEQINNQEEGKKLSIAITNKEWYQFIQDKKYQE

SEQ ID NO: 431 - protein, 1321 aa, unidentified
MKDKDIFSNFTNQYQLSKTLRFELVPLRETEKFIKEKGLLKQDKKRADDYKEAKKLIDEYHRDFIEKALSGKKLSNQQLKDYLNEFIKPERDNKVLGQISEALRKEIAGWLKDNPTKDGKKLIEEKVPEFLKEQGKNEEAKLVSCFKGFTTYFGGFNDNRENIYSDKEQSTAIAYRIVHENLPKFIANIRAFQNSKDYKIDFSEVQEQMKEQLDGNKLKDVFSLDYFNNCLTQSGIDRYNTILGGKTSFKGIKIQGVNEKINLFRQQNNLTGKQVSIMAPLYKQILSDRVSASYLPEIFESPDVCLNAIKAFYEKDIKAFASPVWGNKVKNVIDELETLFTKKLNAENDLSKIHIRNNFITAVSQQIFGSYPVIADALRSHFQKGKKQTKKLEDETNKYLKKSYFNISEIETALKVYLQETEIDNEEKRAEILKQKNPVLQYFNSLTSNIEIAKDKKEKTNVIKHFRQKHEDKSVQTVLNRKYKSNSELIQDKKAVGAIKDYLDSYLHILHFIKPLYVVPPKKENGEIPDKDNSFYAEFDELFRQLNSVIPLYNRVRSFLTQKPHSTEKIKLNFENKGNFLGGWVDSHTEDSDNATQSGGYLFRKKNPIGEYDYFLGISNDKKLFRSHLQNEVMDKSEYERLDYYQLKTASVYGNSYVGKNSYSKDKERLVEAILSFSKSQDESFVSELNKYLEKETPTPSGCFSLIREKFPDSFEKLIGYKEFLTANNEVVENLKETLGSLKRVPSAQKYASKNYVFFSEVITDIEKLAKEKSCSYFQVSQKELDEVLNRSEKPLLIFKITNKDLSYAEQFLKGKRKSRGNENLHTMYFKALLSGEQDGFDIGTGEVFFRKKSLNYNEKTLKQGHHIEKLKDKFNYPIISNRRFAFDKFQFHLSVILNYTKPDSKSNEFNDKVNRALKENSKVNVIGIDRGERHLVYYTIINQNGEIINDDKGNVLQGSFNEIKNEHNGKIYNTDYQDKLKRREEERDKARKSWDTIGKIKELKEGFLSQVVHKIAQLMIKHNAVVVLEDLNFGFKRGRMKVERQVYQKLEKMLIDKLNYLVFKDREAGEPGGVLNAYQLTAPFTSFKDMGKQTGFIFYVPAANTSKIDFATGFVNFLYPKYENEKQAKEFFGKMEDIRYNKARDYFEFDVDCNKFRTDKAEQLKKSRWTICTYGEERYHYQLSKREYNKVNVTEGMKGLLRKQGIEFDKGNDIRKAVIAVDNAQFLKDMIFYLKLTLQMRYTDGNDRDFILSSVADEKGVFFNSEKAADIEPKDADANGAYHIALKGLLQLQKIRVGEKKLAISNKEWHDFVQERAYRK

SEQ ID NO: 432 - protein, 1296 aa, unidentified
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWENRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDSPTLANGWDENKIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFFFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 433 - protein, 1035 aa, unidentified
MAKNSIFSKFTGLYPVSKTLRFELKPMGKTLEKIKETGIIENDKKRHNDYFDAKKIIDTYHKYFIDAALSKFSRIDWNPLKEAIEGSLDRSDASKKKLEKTQTEFRKKIAKALTSHDHYKELTASTPKDLFLKVFPDHFGKQAAIDTFDGFSSYFTGFQENRQNIYSDEAISTAIPYRLVHDNFPKFLSNIEVYKNLSDYAPDVLSQAENELKDFLNGKSLANIFELNAYNEVLTQSGIDFFNQVIGGISGEGGEKKTRGINEFSNLYRQQHPEFAQKRLATKMIPLYKQILSDRETKSFILESYSTDSQVQESVKEFFESQILNCDIAGRKVNVLNELTSLIKRITEFDLGSIYINQEELSNISLELFKSWNTINAILFKNAENRIGSAEKAANKKKIDAWMKSNEFSIATLNLAIAESDFEEISRVKIESYWNDFEEKVQSILCGDNRKNLDEFLSANFNENNALREDSKIIEKLKAFLDALIEIMHSIKPLISDAENRDLSFYNELTPLYDQLSLVVPLYNKIRNYATQKLTESEKFKLNFDNPTLADGWDQNKEEANTAILLLKNGLYYLGIMNAKNKPKIKDFKTSESEDCYDKMVYKLLPGPNKMLPKVFFSEKGLATFKPPKDILDGYNAGKHKKGDLFDIGFCHQLIDFFKESIAKHPDWKKFDFNFSDTSSYEDISGFYKEVTDQGYKITFSKIPTSQIDEWVNEGKLFLFQIYNKDFAPGAKGSPNLHTLYWKSVFSPENLKDVVVKLNGEAELFYRPSSVKKPYSHKVGEKLVNRIGKDGLPLPESVFGELFRYFNGKLDGELSDEAKRYLDVAVVKDVKHEIVKDRRYTQDKFEFHVPLTLNFKADSKNEYMNERVRQFLKDNPDVNIIGIDRGERHLLYMTLINQKGEILKQKSFNIVESVNYQAKLVQREKERDAARRSWSSVGKIKDLKEGFLSQVIHEITTTMIDNNAIVVLEDLNFGFKRGRFCVERQVYQKFEKMLIDKLNYLVFKNKPEGDVGGVLKGYQLAEKFDSFQKLGKQSG

SEQ ID NO: 434 - protein, 1264 aa, unidentified
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNKITEAFRKNSLFTNLFKKNLIKEYLPAFVSEEEKSVVNKFSKFTTYFDAFNDNRKNLYSGDAKSGTIAYRLIHENLPVFLDNIASFNAISGTGVNECFLGIETEFTDTLKGKRLTEFFQIDFFNNTLTQKKIDNYNYIVGAVNKAVNLYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLSGWSDNQTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 435 - protein, 1169 aa, unidentified
MLLTDKERATNYERIKPILDKCHIKYIDDQMSAYSNDWSELYEALISAQKDKNLKKDLEAVQKKYRTKISKFVKDKKKMELLAPKTLINNAIAGDYYVPEMKDNVDLFHSFNKFATYFTNYQQARDNMYKEDGSTAIAYRIVNEIFPQFVSNIKLFNDLSEEVKTQIEKDTERLLGVYPLNKIFSLEFFNNVLSQKGIDFYNSIIGGITASDGITKQKGVNESCNICYQQGLLNKKIVFKLLYKQILSDRETVSFVSDMFESDYALNEALKRYCLTVNSTLNNFVDDLQLVFSKENVDLDKIYVDKKMVPSLSVVSFDNDWRALKDRLANNGIKSKDEYALKELQQCSEVDLLEKVYKNIVELKGEILKAEELLQFNAKISSYVEIKNYMDLVQKLEKLLKIFCANDDNEKEPLFYGVHEKIYSVLRENIPLYNMIRNYATKAPYSTEKYKLNFDSPTLLDGWDQNKESSCLGMLFLKGGKYYLGIMNAKDKPVLSESDEKRENCYAKMVYKYLPGPNKMLPKVFFSKKGLSTFGASDYVLNNYNAKKHIKSEKNFDLKYCHDLIDYFKEKINEHPDWSKFGFKFSDTKDYENISDFYNEISKQAYQVSFSYVDDATMKKAVKDGKLYLFQIYNKDFSEKSTGNPNLHTIYWKELFTEENLKTPIFKLNGQAELFYRPSSIENPFVHKENSILIRKKDKLGRAVNEEIYKLAICDVENGATIDELEKKYPNLLFRKAPHDIVKDKRYAQERILFHVPITINNSVDEKYKKFNEAVLRHIEASDDFHIIGIDRGERNLIYISCIDLKGNIVYQRSFNVVSNTDYHEKLDSLEKIRLDERRNWEAVTKIKDVKSGYLSQVVHEIVKLMMKHPSIIVMEDLNRGFKQGRIHIEKQVYQNFEKALIDKLNYCMLKNLPSNQEGGARRAYQLSAEFESFERLGKQSGFIFYVPARNTSKIDFNTGFVNLFTSAQLKYESVNKSKEFIGQFDEICYDSLDCFRFDFKYSKFTLNQRDFKDSWSIYTIGEKRIAHTKIDGYDTTREVDVTEEMKQLFEKYGIDYTSNLKAQIMEVDDKSFFKTLLWLLSVTLQLRYENADNDFILSPVQKDGKFYDTRKASENEPCDGDANGAYHIALKGLQLVKTQIEDGKIIADEKGQQLYNFLKFAQSKDYQK

SEQ ID NO: 436 - protein, 1306 aa, unidentified
MLNYPNLSNFMVFATQKGEMKMARTMSEFTGKYKLSQTLKFELQPVGVTEQRLEESKLLEQDFKRAEDYPKAKEFLDGKHKEFLQKVLSGITDIDWQPLADMLDQFQKNKDLEKELEKRQGEYRKKIAGKFTGDTSFKLLTDPTPSKLFKESIKADPALQAEVRTFEGFGCYFTGYQENRANIYSDKEQQTAAAHRAVNENFTKYHAAVLNFQEICNASAELAQDINSRTTSILNGEVLTDLLTIRNYNRFLSQCGIDLFNRIVAEINYEVNQYRQRHPEQTKKVRFLPFLFKQILSDREQTFAVKAFADGTELLSALKDFIFRNQKMKIRGETVDLFDSLRRVLATLKDDDDLFINSSEMGRISSRLTGSWSTFQDSAAAYAKATLRSKAKIDKYCKDVFHFRDIQTWGIEQYEENGTSKPLSLSSYWRHDDLAVLFEQEKRKRNEILALAEKGDPNQLREREDDVRIIKEYLDTVQDILHYVKPLEVDDTYGGDLDLKGILMEHYLPLKEAIIPLYNQTRNFILKKNADVPKIKLMFNNPICAGGWPDPQTSSCVIFRKCHEFYLGILSDKARSCLNSYDSEEDSDWEIMNFRQMADPSKDLPNLMQIDGKTVRKTGRKDEKSGKNLILEELKKRYLPEAINRIREKESHKKNSPAFSKEDLAAYIDFYKDRVMEYKPDYEFKFKPSEEYAKWEDFTNDLDAQAYQLNFFPISESFIMQLVDEGKLFLFKIWNKDFAPKASGKPNKSTLYWKAVFDPDNLSNVVFKLNGEAELFLREPVIHEPKAHRCGEKMVNRTIASLQNGQTVRTPIPEDVYGEIFQYVNGNKEMPALSPDAKSYLEKRLDWKQGMKFEDTLGRLVVKDVTHEIVKDKRFTERKFFFHVPLTINFKSPDGKGVKFNDLVRDYLRNNPDVKIIGIDRGERNLIYLVLMDQNGNILQQKSYNIMGGIDYQAKLDQRQKERDAARKSWQEIGGIKDLKAGYLSGIVYEISRMMVEHNAVVFLEDLNTGFKSSRTKIEKQVYQKFENALITKLNYLVFKDTDDHRSPGGVLNGYQLTPPQGNINQRSSQCGFIFYIPAWCTSNIDPVTGFVNLFGSEWLQWKNIAQTRKFFAEFDAVRYNSADDLFEFDFDYRNFTEKGEGTQTRWTVCSVGERIESFRNPEKLNRWDCRTISLTAAFKDLFKRNGIDIHGDLAAQIQAAGESQEFWRELHHLFKLTVQLRNSNPGSADRADDYILSPVRDRNGVFFDSRKASSDWPCDADANGAFNIARKGLWILQQLNSLPAGDSKKLPVMNQKDWLNFVQKQ

SEQ ID NO: 437 - protein, 1271 aa, unidentified
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFETRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDNPTLADGWDKNKESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKIFFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 438 - protein, 1293 aa, unidentified
MANFNGFTQKYKSPKTLRFGIVPLGKTLENMNKYGIISEDRQRNENYKKIKSVLDRFYKTYIEMCLKDVKIDWGPLYEAVVAYRAERSPENRDDLESLQKRYRKTVVGLLTKNKELFKALFSKRLFDGTVASKLPGLILTAEDEALLDSFKGFTTYFDKFFKNRKNLFSAEKEHSAVSYRLVNENFTKFVTDCEILKRIGETVPDVLETLRNTSSLQLYEGCCLEEIFSADFYSSLLGQEQIERFNRLIGGISAAPGEEKVQGLNETMKVILDKSPDEELAAVPHRFVPLYKQLLIDRQAPSFILKSFGSDRDVLDAVEGYLKMLESGQALSNIRALFNGLETCADLQHVYISNDKLSAFSSSVFGQWNLCKEMLRDWKIGDKDRKITKKQTAGIDKWLKNSDFSISEIWQAAGDELPAGKIGEKILKLVDAVEERAGIPLPESLKTPEEKEILKTFLDSVMDLLSRLQWFDVDDCNGKDMGFYGPFEKALQTLRPVRLLYNQVRNHVTKKPYSLSKIRLNFSNGQLGKGWDENKITDHCAVLFTKGGQYYLGILNKNNRPDFETPIPVAGEARYKRMVYKQTKFTTTVPKCATNRKDVEAHFSVSDDDYVLFGENFVNPLVITKEIYDLNHVEYGNDKNDDKHKKIQAEYLKYTGDQEGYTEALYKWIDFVKEFAKAYKRTSVNDMSSVLPTEQYKNLLDFYTDMDKTAYEIVFQDIPEKVIDAFVDEGKLFLFRIETKDFRAGSTGRPNLQTLYWKALFDPENINNPVIKLNGMIELFYRPKSEMNVVRHRVGEKMVNRVLKDGRPLDNELHSEIYRYVNNMLDRRLSAKEKAVLPLVTVRDVPHELTKDRRFTEDKFFFHASIVLNNKSDKTTAGFNKDVREYLKNNPDMYVIGIDRGERNLIYAVVISPEGRIVEQKSFNVVNGFNYHHKLDQREKERIEARQAWNIVGEIKELKAGYLSNVVHEISRMMIKYNAVVVLENLNLRFKQVHGGIEKSVYQQFERQLINKLGFLVFKERTGSSPGSVLNAYQLTDSTKTMEKTGMQNGFLFYVPAAYTSAVDPATGFCNPYVFSKVKNTKADIEEFLKGIRSLRYDRLTGDFIAHLDLSQNGRFQRELEGILPEWDVVLEANVMTKSFDGTSFIRGKRIEFRRDEYGHAQYDTYLPCQALCKALQQSGIEYKTGEDVLPPVLRKKDPVLAAAVFKALRLGLQMRNSNAETGEDYFSSVVKNGAGPCFDSRSADETMPKDADALGAYHIALKGLLALEKLRKGESMGIKNAEWLQFVQQRHS

SEQ ID NO: 439 - protein, 1310 aa, unidentified
MNKKVMDQFVKLEQESKTIKFRLKPQGKTAEILQEAHSLKNDKERVKAYSIVKAMLDRGHRQLIQNTLEQESRSATISWEALVQAYMKSDKSPSDKKAKEGWIKEQDRKRKEISKLFTDKKEYKNLDGKNPFDVKNSMNLLTVAQTEEERKAVKSFSGFSVYWKNYYENRKHIYSEEKKSGTIAYRMIDENFIYYMTDYIRFNHIKEKDNVFWKEISEKWLEESDLPIMEIFSFEGYRYFLSQMGIDLFNRFVAFYNLEANLYYQKRGNGLDAAHPFHKARNRKLIPLYKQILSIAERRFEIPAFHSDEEVLNAVSLIKEYVIESKLQEKSIALFGDKEENNGEYCIKNQSLTTVSYTLYGKWNLLSDALRIFYLKNQKSSLSEQKKLDNVEKLMHQTNFTLSEVEDALKDYAEVIEENEELLNKIKNPFWCLCVQKVKELWMSFWEAEQKYMAFVSTWNKANNLKEEATTDIRDYLDKMNEIIRFLKLFQVSIEDFAQLDIAFYNQLGECIERAGVFIQTYNMTRNYITQKPYSEEKHLLKFDIPTLGDGWSVDKERDNGCLILRKNKKYYLAIMAAKHRMALESSATAEEESYEKMNYMLFKDISKMIPKCSTALNEVRSHMENELGEYCLDGSRFTKPLIITPEIYALSREEEGVGYKKWQKEYLRRTGNEEGHKAAVKKWIAFCFEFLQKYVSTADYDYSSLLPLEKYESVVDFYAEADKLLYRLDFGYIAKNKIDELVEEGKLFLFQIYNQDYSEHKRPESKKNLHTLYWEALFSEENAVHRIIKLNGGIEVFWRPSSIKKSVKHQAGEVLVNKRTKTGAPIPDDVYKELVEYFNGKSVELSDVAQKYETEVYTSQKKYEIIKDKRYTEEQYEVHIPLTLNFCGEKAAGINQRVLQVLHDNPEMNVIGLDRGERNLIAYAVVNSKGEILKQGTFNTVNQMNYQERLKQKEEIRQEERKSWKVVENIKELKEGYISQVVHELTEMMLEYNAVIAMEDLNFGFKKGRFKVERQVYQKFEMALLKKLHYLVTNKEEGEAMNQPGGTLCAYQLAEIPSSLKNIGKQSGFVFYVQPSYTSKIDPTTGFADIFDFSEITKTSARKAFFEKFDDIFYDEGLDMFAFSFNYGNFAVYQTFAKKDWVVYTNGERYVWDNRLRCSKLINLTEELKSLFDFWKIEWKAGTLKQILHEMPDTKEKAGFWNSLLYYFRVSLQLRSNLAGEQEDRIISPVKNEKGKFFATPAYAGMDFAQLHQYDSLPMDADTNGAYHIALKGHLMLEKVAMAEVTPQGKVVGEVLRISNPEWFAYRQK

SEQ ID NO: 440 - protein, 1333 aa, unidentified
METLFENFTNLYSLSKTLRFELKPVFNSKLSKEEKTVALDKYWSQYLNSEIFKHDDERDKSYPVVKSCIDIFHKRFIKDSLSRFESDKWERLSDLYREDKKGKEYKDLQKEIRTEIADNFKKHEWWQYVDSYSKLIVLLTDLLKTDDDFRSEAMEKVGEDVDNILEHLDRFKHFSLFFETLKKNRDNMYSKDAKATSIANRLVNENFCIFVDNIAIYNRLYEVCPKELEVVEKNLSSYLNGLTFKEIFTPSYYNKCLTQNGIEVYNWLLGANPNQEVLGINSIGNEYLQKNPNTGLRLKDLRMNKLYKQILSERERFSFIPEQFSQGTAGEKQLVDAIDSFVNCANGQDLLGKAKAVFAQMLTDKVNLDNVYVSGKHISELSQMLYGNWNKLGEALRSKTTKSKKELEKDISEWIEKKTYSVNEILTLEKNGKLVEEHNISLADFIKGAKVPMWYSDIKAWKDYAFLDECNISYCTEFKAIKEKVAIGESIRENDDAKEVIKSFLDKWLLCLHCLEIFRVDDCKKEKDPIYYDYDALFETDDDKNITFRDIVPLYNKVRSFLTRKIKDEKKISLRFDCATLAKGWDENKENANNATILIDEGKYYLLILNPTNKPILDEARTGNGGFKKIVYHQIGNVAADIPNLMVENGKTVIKRGRKDENGENKKLKEYKKKLLPDDIYRIGDSGSYKRSSSIFNEYDLHKYVAYYMQRVIEYKNGEIEFHFKSPEEYDSYDAFLEDVSQQNFSLSFVDFDGEVVRQWIDDNKVMLFQISNKDFNENAHGTANMHTLYWKEIFSKRNLDDIVFQLNGETVKLYYRKNALKNPYVHKESSVLVNKTYTDGTIVQQEDYMAFLKYYNSGGDLTDKQKKLLPNVCTKKAKMDIVKDKRFAEHKFLFHVPITINFKSPQAPTLSEFNSRTIEILRRCKDKINIIGIDRGERNLIYVSVIDKNGNVIRDENGVPLIRDYNIIESKLYEDFVRKYNYLEKLKQVESDRDKARKNWDVINGIKDLKSGYLAQVVHEISKLVVKYNAIIVLEDLNYGFKRGRFNVERQVYQNFEKALIQKLNYLVFKTDAPSPRYGNVHNGLQLTAPFTSFKDLGKQSGWLFYVPAEYTSKIDAETGFVNLFNMKEAAKDPKNFFEAFKSIEYKNGLFYFKFDYSNNKLPTVKSDYTNNWTLASYGNRIKITKESGSSKFVQKEVVLNDEFKSVFSDPKHQLSLDKISKENIIKHDKSDSLCKDLFNAFKLLLQMRNSMSNSSIDYLISPVESEHPFVTGENNQMCIKDADANGAYHIALKGLYLIEHDFPVEKGSLQRISTSQWLEFVQTKAYRKNNV

SEQ ID NO: 441 - protein, 1210 aa, unidentified
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNTSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDNGTLAAGWDITKEKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFEFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 442 - protein, 1248 aa, unidentified
MNKTFPFNGMKKLFPVTKTLAFQIIPVGKTQENLNRQQTLEKASELKKDYESLKAASDRVHKRFIEDTLSKFHLKYLSDGANDSIQEYADIFLDATLSPEEKDVLITEVAANLRKQVADAFSAVRYNEKDTMLKALASKALLTEILPAEDLSDTEKASLGRLSQYTTYMRPYFEARDRMYEADQDGHTIPVRIIGDNLPIHLTNVRLFGALPEEVASGAAEIFSALADRIEAFELRDVFTASFFSMLCPQSAIDTYNTLIGGISKEDGTRIQGLNELINQYNQKQGKDGKKLKQFKKLKKQILSDRMSLSWLPDTLADDRQAVQVAFGLEDLLAGFTPADSTSWNTAAVHVDAKRLGIYSNAVFGHWKEAESCLLKVYSEAFPKKSREGDKGYAERIGKIFKAAKYFSLDEIHGAVAKYGSLAPDSPAASAPSALRQYYMDKIAAKVTEARDSIGLLHAHVDADGMPDAKLGQDAVSGELGPGAYMKDFLEQFNDAKNAALVFTDLGGILDTDQDFYGRVVDFFGDVSRGLKAGYDAIRNYLTKKRYSTDKIQLYFDNPKLLDGWDTNKEPDNRGVILRDGDDIFLGILPAHAKRLFTYGKHLDPASPLKKMDVKFIPNPHMMLPKVAFSKKALSEGNIPEPVMNLYRSGKAVKDYTKEEVALMVDFYKGVIASNPDWGVFGFQFKEAADYERLADFYHDVASQGYKTVFSGVSRSFIEKAVDAGDLFLFQVSCQDMLERHTGKDGNYKALLYEALSGKIGGDVRLCGGGAVYFRPTSLPRKVTHPAGVPIRTKNPDSEREKVTYVYDLIKDRRYTEDRYAFHIPVSIYPDADAYGALSVNRRVQEIVRENPGMYVLGINRGERNLISIAVTAPNGTIVEQRNLNVFDNFDYRRKLAEREKERTENRRNWTSVKEIKNIKAGYLTRVVGEVVRLVKKYGCVIAMERLDMDFKTGRQAFEKNVYEQFERDLVSRLSFLADKNETDRFGTVLQLANPGKTEIERTKFPQNGILFLVNPAHVSKTDPLTGFVNRLNLHFGKIAEAETIIDGFDGFRFNAKTGRFVLSFHYDKAAPGKEAGDGQKVWNVETYGERIEQERVENAPADTFTDKVTVLTSAMKELLDSAGITWNDGEDLLGRLKGQGTDFYKSFFGLLRLTMRCTSWDSATREFRIIGCTANASGQFYDSRRAPERLPKDGDTLAAWNIARKAHILLRNIRDFKQDAATDENGKKAKSPRTVVSDADWFAEIQK

SEQ ID NO: 443 - protein, 1121 aa, unidentified
LSKTLRFELKPIGKTAEMIKANGFLEHDTKRADNYVLAKQLLDDYYRYYIEETLKGKELDADLVAKAYSAYVKGDTKECEKINKELRERVSKIFVDKDKYGLEKYKELFSVKQNRKTNRTEGILLSWVRNNDKYSQADKEKYEELIVYFNKFTTYFKGFKQNRDNMFSAEAEVTAIANRIVNENMYRFFDNVKNFENIKEHYPDLYKEFVQVEQYFVPSAFGKILSQSAIDNYNQGVIGRFENDLDAEGVNQVINEYRQNCLKDGKEVKKLPTMITLYKQILSEDKSENISEKENIDTDEKAINLVKESYKILTENVKEIKKLIDYSITEETLDTIYIKKIEISTVSNAIFGNREIIKDALNYKKEKYKEVVCVKTISDAIKEYKQVYDGEIFDWKDKNIDDLFVKYFSSFYTGYVTKSKNTKKQKDEIVNIIEYVDNIKKELDTIVSNDVRDYKNILDKMNAIVRFYKMFYLYDGMKKLDIRGKNEYFYNHFELMYFDIREINKKYNEIRNYATKITQPNNGEKLKFTFDASTLLDGWDKNKEKDNLSILLVKNGKYYLGVMDNENKKCFDFENEDVAKKAGQVGEKYQKMEYKQIDWNGFFTRCSGTAKKLGWNCPEECKDKNGKLIQSDAEAESNLVKIIDCYKDFLNIYEKDGFKYRDYGFKFLPSNQYRKLSEFRADATRQSYKIVFRDVSAKYIDELVEQGKLYLFQIYNKDFSDNKKQKGTDNLHTLYWKALFSPENMNKTDGAIIKLNGKAEIFYRFKADGIPVIHKKGSILLNKISKYGETIPSKIYKRIFDCLNGRIEKQDLNEEERKWYDKAVWKEAKYDIVKDKRYYGDDGKYFFHCPITINFRCKEKVNGNTFNQEINQFVANNPDIHIIGIDRGERHLLYYTVIDQQGNIIEQDSLNNISSDYVANNKLVPHKVNYHDLLDKREQERADARLAWTAIENIKEIKSGYLSQVVHKLALLVEKYNAVIVLENLNVGFKRGRFKVEKQVYQNFEKALIQKFNYLVFKNRSYAENGSFANGYQLTAPFTSFKDIYRQTGILYYVDPSYTSHICPKTGFVNYINSYLKYTNVETAKLTLAKFDGFKFNNAKGYFEFVIDYDKFIKSTGSLGK

SEQ ID NO: 444 - protein, 1385 aa, unidentified
MNNILSTFSNKYQLSKTLRFELKPIGKTLEHIQTKELISEDDQRAKSYQKMKKTIDGFHKHFIELAMSTVKLTKLETFQELFNASPERKKEESYKKELEKVQDSLRKEIVKGFSTGEAKEIFAKIDKKELITELLEQWIQQQKEDDFYFDEKFKNFTTYFGGFHENRKNMYSDKAQSTAIAYRLIHENLPKFLENIKIFEKIKSVPEVYEKCQTLYKEIEEYLNITKIDEAFELDYYNEVLTQKQIDIYNLIIVGRTASEGKTKIQGLNEYINLYNQKQEKNKRIPKLKILYKQILSDRVSTSFTIDKFTKDLEVLDAIENYYKFDLLSYQPKDKEDAENVLERVKEILAHLADYDLSKIYLRNDTKITNISQKMFGKYGVFSNALAYYYSTVLKPNFIEDYKNANTKKREKLDKEQEQFLKQEYLTIDLLQNALGVYIPTLDPDEEIVKRYTPQCVADYFKDYFKAEKEVGKDKEFGLIVNISNKYSCIQGLLGTDYPEDKKLVQQKEELFNIKAFLDSLMELLHFVKPLSLPNDSVLEKDQNFYGQFEPWMEQLNGLIPLYNKVRNYATQKPYSEEKFKLNFENSTLLDGWDVNKEEANTSVLLRKDGFYYLAIMDKNTNYLFEYESYEAEKVKDLLEKEEKLKSKKEKELVKLNQKTELSDKDKVKQEKLKNQLIEHTNKIAVFYLTKTKTSETVFEKIDYKFFPEASKMIPKCSTQLNAVKNHFKKKTDDFIISGDKFKNNLTVSKRIFDLNNYVYDAETNSLVKPKEKDEKRPKLFQREYLEQSGNNEVYKNALRDWISFCKNFLSTYDSTSVYEFSFDENPPFDSLDSFYTYINTITYKVTFRIISEMYINQLVESGKLYLFQIYNKDFSTYSKGKPNMHTMYWKALFDEENLKDVVYKLNGQAEVFFRKSSIKNPVVHKANEAVANKNPLAEKKESVFDYDLIKDKRYTIDKFQFHVPITINFKATGKEFINQDVLDFLHQNPDVNIIGLDRGERHLIYLTLINQKGEIILQESLNNITAENHPITTSYHELLNRKEKERDEARKSWGTIENIKELKEGYISQVVHKIAKLMVQYNAIVVIEDLNFGFKRGRFKVEKQVYQKLEKMLIDKLNYLVFKEVNPKEPGGLYNALQLTNKFTSFKEMGKQSGFLFYVPAWNTSKIDPTTGFVNLFDTRYENLDKAKTFISKFEDIRFNPAEKYFEFVVENYSDFNAKAEGTKQDWTICSFGERIKTFRNPDANNQWDNKVIQLTEEWKALFEKYKIDYKTELKEQILQQTEAGFFKAVLDLFKLTLQMRNSITNSEVDYLISPVKNKQGVFFDSRKADATQPKDADANGAYHIAKKGLMWLEQIKSFNGTDWKKLDLDKSNKGWLQFIQNKK

SEQ ID NO: 445 - protein, 1230 aa, unidentified
MKSDFFAPFTNLYPIQKTLRRELKPLNENFEYDPSLSSLRNSEIPQRDEQREKDYQAIKPLLDELHNQFITESLQSLETQDRSDFVLFYQTYQKKKKNKAELSEKELKILDEEFESRTKALRSAIGTSFLNTAELRKSNPDYVNEKGKPFLTQKSYKILTEAGVLGLLEKKYASEPENLALIRRFGNFFTYFTGFNQNRENYYATDEKVTAVAYRAINENLLTFANNCELFEKLSVLSLSDLEKKIFNPDSYSEYLTQSGIDFYNEMLANIRSKANLYTQEHKTKLPQPKLLYKQIGSPRGNTIPFDLINNDDEFKKMLHTMIAETDQRIPEFKKLLEPIFEGKADLSQIFLSKTALNIISNRYFSSWHTLLEKGVELKLFKFKKNDEESFKLPAYLSLTELKELLEAVPFQTAEKSGTAEGTHHQVSLLKLQRENLHLERSNSNWELLLKSMKSDFESFWTGEGEFGSYTSAKKALQSLSSLQSNNQEHKNLIKMLLDNALYAYRMLKWFKVDTSKLGFVPEGEFYPSLDQLLQGYPLPKWYDMIRNYLTRKPYSQAKLKLNFDCSTLLNGRDKNKETQNLSVILRKDGKFYLAIMKKDQNKFFEKSALYEGNLGTMEKMDYKLLPGANKMLPKCLMPGSDKKKYGASDQVLELYAKGSFKKSEKSFNLADLHTLIDFYKSALPKYEDWKVFNFQFQATENYQDISQFYREVEQQGYLLNWRKVNEELIKQGIKDGSLFLFQISSKDFEGKSKTPDLQTLYWQQLFKSPTNVKLNGEAEIFFRPGSMKKEKKTLKVDNYDVFKHKRYTEDKILFHVPITLGFGNNEVTSKFNQKLNQELIIPHFDDLHVIGVDRGEKHLAFYSVVSVKTGKIVKQGTLNLLNGTDYEAKLSQKAENRLHARQNRDTIEKIADLKNGYISQVVNKLVELVLEYNALIVFEDLNAGFKRGRQKIEQSVYQKLELALAKKLNFIVKKEKAVGEPGSVTSAYQLAPQINTFGDIKGKQRGIMLYTRANYTSVTDPLTGWRKQHYFKKGSSEEMKAQFFKSFKNLTRDAGQEAYIFDDGTWQLYSNVERRRGKRGDHRERTQIKYDPSLELDTLFSKYQIEKSDSLLDQLKNRDLPQTFWTSFFRILDLIMQIRNTDDEGRDIIFSPIGNPQERFDSRKRYDQLPRDEKGLVIEESAFEYPTSGDANGAYNIARKGVMMLERIKENPEKPDLLIRDAEWDSWVV

SEQ ID NO: 446 - protein, 1370 aa, unidentified
MNGENRKGIFDDFTGKYSLSKTLRFELKPIGKTLENMRTQFGYDENLRTFLSDQNIEDAYQALKPIFDKIHEDFITESLESESVKSIKFSSYLDLYERKSDIKEKAFEVEEKKMRSAFGDAYIKVAESWKNVAGKTEKGKEIFSGSGFKILTEVGILEYIRKNADRFSDILSLDEIHKYLNIFEGFFTYFSGFNQNRENYYVTRDEKATAVATRIVHENLPIFCDNVLIFRGRQRVYEDIFESLRKLGDPLVMKGKDKKETPCISIDPNLFRIEYFTECLSQTEIESYNEAVGNANFLINRYNQAHGEKSEKLKFFKTLYRQIGCGRRDALFFELTDEKKSEAEKKRANQSKKKFYSLEELLHDVSEAGGRYFRASDRGDVSDIDVASLGSLPDLIAYIRSRENFTGFYWSKAAMNTISNRYFSDWHSLKDRLKTAKVFQDSVKGSQEDVRIPEAIDLEDFFTVLDSKPESLEEEWHWRDSGVFFKESLTETIECERKEDIDYEQCERRKKRNERYSSIVQNAQKPSRALLEMILSDIGEHVESFVRESGNIAHLSEYTSETSKEAIKSWLDEMLSATQMIKYFVVRPSKIKGEALDSVLAEYLKVFLDSEKDETNWFRYYDATRNFLTKKPQDDAKKNKLKLNFGQSTLASGWDMNKESDNLCVIFRDRDEKYFLGIISKRKEKGYNSLFKKQKENKLYVVEKGEIFSKMEYKLLPGPNKMLPKCLLPKSNRKKYGATDEILKIYDHGDFKKGSDGFSRESLGKIIDFYKSGLQKYEEWNCFDFSFRPTEEYVDISQFYLDVEKQGYKNSFVSVNKTVVDSWVSEGRLYLFEIHNQDSNSGKKEGHKNNLHTMYWDAMFRDIENRPKLNGEAEVFYRSALPEEKQQRADDNSGKSIIKNFRFSKEKFLFHVPITLNFCMKNRAVNREISEKLRDGAQCIFLGIDRGEKHLAYWSLVSEKGELLDQGSFNVVGGKDYNALLEARAGERDFARKNWKTIGTIKDLKEGYISQVVRKIVDIAVEKGALIVLEDLNIGFKRGRQKIEKQVYQKLELALAKKLNFLVDKSAKIGEIGSVTKAFQLTPPVNNFGDINSKQFGIMLYTRANYTSQTDPLTGWRKTVYLKRGSEESIKREILETFSDIVFDGKDYAFTYVEKIKVRIEKGKKKENNREIRNGKTWTLYSGKNGESLDRFRGKRGTDKNEWKVEKEDVVEMLDSLFANLDKKDRNRSLFTQMKGGGELVKISEYPAYESLRHCIDLIQQIRNTGEKENERDSDFLLSPVRNEHTGEHFDSRKYWDAEQRDEKLALPSSGDSNGAYNIARKGIVMAEHIRLGYKTYISDEEWSAWLSGESSWRKWIEENEKDLKWKEKK

SEQ ID NO: 447 - protein, 1253 aa, unidentified
MYTDYIDKLVGGFMDNAFSKFTNQYSFSKTLRFELVPQGRTADFLNGELESDQDRAESYQLLKPHFDNFHDGFIEQSLKAYSDSENRFEQLGDLLQKQQKFDKNSSNYEKLEKDIIKLQKSIRTNLSRFFTGFAKKLNQDYGLGDKSIISNAGAMVDFAKILWKDQPEKLVLLSKFDKFSGYFTGYCQNRTNYYVGDDKSTAVSNRIVNQNFTKYTQNFIEINKDEFKSFLKWFNQEDRYIYNQSTKQGQLTHINPEMFSFAHYTEHLNQSGIETYNFNIGDINYWINQFNQTKPPKKVKKLLNLYKQIGQIPVDKKELFKFYETDEDLATDLLVTIENLPKYTENANTLFRNLADEEFNLEEINISARGTNSLANKYLIGWESVRELVNSNKKHDSSNKLIKLSEKPKSTTLGSLNEIINQFEPNQIFKPKYLNNLSDEPGQPSEILIWLIKESLLNALKESKDLAANLNLNKQSKLLGEKSITENIKTFLDSLLLSSQIMKTFQVDGALGDSDFYNELDQVLNEIDIFSIYNATRNYLTKKPYSQDKILLKFANSSLLDGWDINKESDNTSVILRDSTGYFLAIMKKSSNKFFDKAKNPLLYQVDSGDLEKMDYKLLPGPNKMIPKCIISVFWNKQEKQIVRDKPTTIKLAKSGISPSDEFIYKYNQGLHTKDPETKKIRDKKYLVEYIDYVKDALNKYEGWQGYIFNFKSSDQYQDTSEFYKDISDGGYSLNWSSIDLDVLNKAVDEGEIYLFKLKNKDLARKSKSNGKPNLHTMYWQNLFIDESSFKLNGSAEMFYRPKTIDKKQKVFTGSGIKKSGIFEKNRFTENKYLFHVPITINRKANNVIKFRDKINQAIIDEKITNVIGVDRGEKHLEFYCLLGKDGEIIEQGSLNVINGADYSKILDQKSSDRNEARKNWKTIDQIKDIKNGHTSLAIKQIIDLAVKHNALIVLEDLNTGFMRGRQKIEKSNYQQFELAMAKKLNYLVSKDTPAQQVGGTNKGLQLTPILNNYSDIEKVKQFGIILYTTAGYTSSTDPVTGWRKTVYLKSLNQDSMKNDISKFSQIYWDNKEKCYIFSYDTKNFNSKANSRVWSLYSSVERLRSERNKNGIWEKKQYSPTDVMRKALVNSGINPQSANLKEDILSMANSRSLKDIIFGFNLICQIRNSGTSVRDSDYILSPVKPFFDSRKQLDEQNLNENPNSNQLPTSGDSNGAYNIARKGQIMLSRVKQNPEKPDLFISDSDWDKYLAED

SEQ ID NO: 448 - protein, 1285 aa, unidentified
MVDSLFSDFTNIYSLSKTLRFELKPIGNTQKMLEENQVYEKDKLIEEKYQKTKPFLDRIHREFATESLVNASLSGLEDYFQVLKQWQENKENKKALRSSEAELRNQIGQFFNDKAKTWSEERYSNLPFKNKDIELFFEEEVFSLLKQSYGKEEGSLMIDETTRKQISIFDTWKGFIGYFKKFFETRKNLYRTDGSSTAIATRIIDQNLKRFCFNMQIFEKIKDKIDLTETELNFAISLDELFSLNYYNKCLLQDGIDYYNRIVGGETKENGEKLKGVNEIINKYHQDHKKEKIPFLTPLDRQILSEKEKFRKEIENDDQLLATIREFYDIAEEKSKILQALFTDFVSNNESYALEEIYLSRQAFNTISGKWTEEKNKLEKWLYEAMKPDKPTGLKYEKIEDSYNFPDFIALSYLKTALETAPTQETVKFWRERYYLTKNDPNRIHRPLSGSEPIWNQFLKIFNFEFSSIFKNEVRNQKSGEQEVIGYDIYKKYFRELADGKNITITPESKIVIKNFADTVLLQIYAMGTYFAVEKKRAWLMEYSLGEFYTDPEIGYLKFYDNAYEGIVQNYNLLRNYLTKKPWDGAQKWKLNFENSTLADGWDKNKESDNFAVILRKENQYFLGIMKKGHSKIFSDRNETQYSDSMDSRSYEKMVYKFFPDPSKMFPKVCFSEKGINYFNPPKKVLDIYEKAEFKKGDSFNIYSMHELIDFYRNCLTMYEGWKDYDFKNLRPTQEYTDNIGEFYTDVSRDGYRISFKNISQDYINKKNLNGELYLFEIYNQDFAIGKTGKKNLHSLYFEGIFSPENAEIGFPLKLNGDAEIFFRPKSIEVQKERRKYTRDIVKHQRYTQNKIFFHSPITLNRGLGDINSYQFNSKVNSALALDPNINIIGVDRGEKHLAYYSVIDQNGKPLENGSLNTINKVDYADKLEERAGGREQARKDWQSVESIKDLKKGYISQVVRRLADLSVKYNAIIVLEDLSMRFKQIRGGIEKSIYQQLEKALIEKLNFLVNKNEINFKKAGHLFKAYQLTGPFETFREMGKQTGIIFYTQASYTSKIDPLTGWRPSVYLKYSSAENAKKDIKKFTDIIFDKNKNRFEFTYDLKKFLDQKEYPSKTIWTVCSCVERHRWNKTLHNNKGGYDHHQNITEDFRQLFVKYNIDYESENFFNMLTTLDTKNYEQFFRNFIFYWSLLCQIRNTDENAKDENSKDYIFSPVEPFFDSRISEKFDEDLPKNGDDNGAFNIARKGIIILRKLSDFHSQYGTCEKMTWGDLSISHNEWDNFAQQT

SEQ ID NO: 449 - protein, 1288 aa, unidentified
MTQRSPVSGGKNPEGQKSVFDSFTHKYALSKTLRFELVPQGKTSESLKAVFEEDKKVEENYQKTKVRLDQLHRLFVQASFTESKVSALKLASFVRAYNALIGVAKKTQTKEQKSAYEKERKALLYEVAGLFDEMGDEWKAQYEEIESVGRTGKQKKIKFSSTGCKILTDEAVLNILMDKFAEDTQVFSTFFGFFTYFGKFNETRENFYKSDGTSTAVATRVVENLEKFLRNKHIVESEYKKVKTAIGLTDSEILALTDVEAYHRCFLQAGIDVYNTVLGGSTELEQSVNKKVNEYRQKTGNKISFLAKLHNQILSEKDVFEMLVIKGDAQLWEKLKVFSEENVAYCTKMLALIRDALTMPEKSGYEWSKIYFSSGAINTISSKYFTNWSVLKGALLDAVGTAKGGGGELPDFVSLQHVQNALDVNEINKGKKPSELFRSEILKHAAFVESVGHFTNLITILLSELDARVAESAVDLADLKKDSFWTTGALSQRRKEKEDEGTIQINRISAYLNSCRDAHRMIKYFATENRRDWVEPEEGYDPKFYDAYREEYAKDIFFPLYNVARNFLTQKPSDENKVKLNFECGTLLSGWDKNKEQEKLGIILRKDGAYYLAIMRKQFSDILEEKKHPEAYRAGDNGYSKMEYKLFPDPKRMIPKVAFAETNKKTFGWTPEVQAIKDEYAKFQESKKEDQSAWKNQFDANKTARLIAYYQNCLAKGGYQETFGLTWKKPEEYVGIGEFNDHIAQQNYKIKFVPVDADYIDEHVAKGEMYLFKIKSKDFASGSTGTKNVHSLYFSQLFSEANLAQTPTVVQLAGNAEIFYREASVEPEKEKRNFPRDITKYKRFTEDKVFFHVPIKINAGTDAMRSQYQFNKILNAELIAKRAKDFCIIGIDRGEKHLAYYSVINQKGVIVDEGSLNEISGTDYHKLLDGKEKERTANRQAWLPVRQIKDLKRGYVSHAVKKICDLAIEHNAIIVLENLNMRFKQIRSGIEKSVYQQLEKQLVDKLGHMVFKDRPELEIGGVLNGYQLAAPFESFKDMGNQTGIVFYTEAAYTSTTDPVTGFRKNVYVSNSATKEKLEKAIKSFDAIGWNEERQSYFITYDPVRLVDKKEKTKTISKLWTVYADVPRIRRERNEQGVWNARNVNPNDMFKSLFEAWNFEDKIATDLKSKIEEKMKNGELSSYKMIDGRERNFFQAFIYIFNIILDIRNSSDKTDFIASPVAPFFTTLNAPKPNPCDINLANGDSLGAYNIARKGIITIGRINDNPEKPDLYISKEQWDEWATKHGIQL

SEQ ID NO: 450 - protein, 1258 aa, unidentified
MSTLEHFVGKYQVQKTIRFDLLPTEKTKRILEGNGKRSKLLLEADKKRAVDFIIAKDVIDRYHRHFIDSVLDSIKEDSNIRELLKSCSTEAGKTELRKKIAEAFQNDSQYNILFGKKLFAKKGKEESDEESKLYSFAKNKSEKAALDSFENFTLFFDGYHKNRKNMYVSEKQTTAIAYRIVNVNLPKFEGNIEIFAKIKNSALATQLSKNKGLKNLLKGKTCEEIFLLGYFVNVWKQSDIDIYNEIVGVINTDIKLFNDKLSDRKLEIPLMKRLFKQILGYKEDENDNWTLRGFESDNELLATIGQFYKIYDTEIATSLRNLLELISTFDLSGIYIHQKSLRVISKVLLGDGYAIPRLLMPQKDNESDEDYYDRIKKGNKSFTIGSINKKTKIDISHYFSNHSFMSFCENEENECKKVDVFETIQTAYDDAKEIINSAKTCPPKGLSSTDNERKLKSLLDSMKTLQHFIQPLLGKGDEKKKDWGFYNEFNEMWEKMLQLNILYDKVRNRMSQKLFSKDKVKVIFDVKRDFLKGWTDSKTDNSDNGTQYGGYLFRKSNAIGEYDYYLGISKNAHILRRKNGAHGEFERLEFYQLKSRTIYQNSYVGSNSYEEDKNKLMETIETFIKKISQHEGNDNLWAEIKKGNTPKAMIAAIKEPILSELLKDEDFAIVNKEVTNNLKNTLLSLTRIPKTQEYKDKEYTMFTEVMDDIEFICSQERVFDYFFVEDEEINAAQNDVDKPLLLFKISNKDLSFAETSSAGKRISRGTENLHTMYFKALMEGQQNVFDLGSGQIFFREKSIPSKVTHPANVPIENKNERVRALRPTRTLDYNLVKDKRYTIDKYLFHLSIKINYQKKELPKSTKSFLYDFNNDTFEYLRQHKENINIIGIDRGERNLVYVSLINAKGEHLSEEFPRSYNLIGNYDYQKKLKQVAKNRDEERKSWSVPERITDIKKGYLSQVVHEIATLAVRHHAIIVMENLSKGFKHGRFPIEHQVYQLFENMLVDKLSYLAFKKDSPTGDYGNIINGLQLAVPCTDVEDLKQNGWVFYVPAGYTSIIDPFTGFVNLFNMNKPANSLREFFEAFDDITYSDGLFYFTFDYSKEAFFKVRKDYTNRWTLSSHGTRIVGKNKEPKGLTKEFELFFEDANLPLDEVSVQTVSSLDESKLQALWGLFKLLLKMRNSNDEQDYIISPVASDKPFITGEENSLRIKDADANGAYNIALKGLYWLYYDFPTDENGYLKYIKDEDWFRFIQTKPYLAD

SEQ ID NO: 451 - protein, 1197 aa, unidentified
MMDFTKFQNLYPVMKGIKFRLVPDEITQEWLNRDQAVLNEQIFGAKVEKAKELITDFHKAHITRNLEMMDMSEILEIVSNYLSTKTYITAKGEELVDDKGTKAYDAMLVDICKKVSVIMDHVAFDSGKKTIDMCIESRSLFTDDDINLLDEVSAYSSSFGDFCKIRKFLYSPKGESNTIGNRIVEIAVDVIGNRNKLATFPDELKQQIEETELDGCSLLSYFDIETFDQASLDLYNTGVSGIAREDGTKEKGINEIINIYNQLHKKEEGYKALPMFLKLKKIPLLDSTTESFKLSSLNSDQECIDMVAYTIDTVMHMIIDMDPVGVFNEYLSIFNMNDLVGINVKKNSLSNLSHKAYGNWAVIGQCIDKKYDAEIGNPKKKPATYQKEKDKWLANKSEYDLKFLTEAVDTYAKSVMGDEGKRIGTPSITLLRSIITELDNSVRTFEEVYNLNRDEFDIPYPETSYLNKDSEKVQIIKNTISPIIDIHQVLSNFSFKRIDEFNIGFYSKVEPMIDILKDADRSYNKIRNHVVKDVDDSGKIKFNFGNPFFGSTFDGDKMSTSGIAIMKQGEAYYILAVPRYDDSKARSALVDLMSTYADHESDTKIMVYKQLSSPFKTLPNIFLNSKKFDDIAEKYGLTERVLRLYEAYKKRKEIDWNQKDEVEIVEYLIKALKMHNINKFYEFDFKEASAYSGLAEFYADVDKQTYKVKFESVSEEMLNEYISKGLIYKFRISSRHLDGSSKGKSLHSEYFKGLFSEENMKETVYKLNATSSIYYRPRKIAEKDIIKHPAGKPIECKTKPGEFRTFDYDIIKDRRYTREQYEIHLTIQCNPNANAYGSAGINQSVRNEIVASNGNFNVLSIDRGEQNLVYVTVINSRTNEILEQKSLNIIGNQDYKEKIKDKSRKMSEDKAMVWKYDNDIKNMKSGYLSLCISEVVNLMMKYNAVIIMEKLDKKFKNSRVHIGHDMYSQFEAALINKLNYYVNKHEDAESSSGVRGALQLTGEFKSFKRLGTQSGVIFYVNPAYTSKIDPMTGYIDRFSGKCGYETIKKSIEFIEKINYIDYGDNMIRFGVEMNKFFPNADEGECWTLKVIRNVNDERVEIWFDKERGGKKCDRDINLYREWLDFFMDNDIDVSGPNETIKEDILSEKRSAAFYKEFLRLFSLTSQIRNIYTTKEEGYVLSPISINGNAPFDSREGD

SEQ ID NO: 452 - protein, 1295 aa, unidentified
MKRFTNLYQLSKTLRFELKPIGKTLDNIKKHGLLKQDTHRAESYVKVKEIIDKYHKNFIEECLNTFANSSETYAEQNENFIKLLQEFYTNYMCKTKDDTLITESQSNLRKIIAKSFNNEKYKRLFGEKLIKEDLISFVKDNVEDIALVQEFKDFTTYFNGFNENRKNMYSDKAKSTGIAYRLIHENLPRFIDNILVFEKIANSDVAQKFTDLYKNFESYLNVNEISEMFKLDYYNMVLTQTQIDAYNYIIGGLNEYINLYNQQQKDKHNRLPKLKALYKQILSDRNSIPWLSEQFESNEKGGKVLEAIQKAYNELEQQILINSNEAEHSLPELLKSLSNYDLDRIYIPNDAQLTDISQKVYGHWNIISKALLEDLKLTTPRKSRKETDEKYEERLNKILKSQSGFSIRKITDSVHNTYPEIESSIITYFENIGKIDNEEENIVSKITNSYNIAKDLLNTPYTGSNLSQDTINVEKIKNLLDAIKDLQHFIKPLLGKGDESEKDEKFYGEFTLLWDKLNNITPLYNMVRNYMTRKPYSTEKIKLNFENKGNFLGGWVDSKTENSDNGTQYGGYIFRKKNILKEYDYYLGVSSNVHLFRRDTIIDSSDISEYERLDYYQLKSQTIYGGAYQGNYQEESRQIIKAIETAINEYGNIEIKDKIEKEQKKNNPRTNTAKGYLGFIKENDFQIYNIIINTQSFKTANQQLIDSIKNTLYSFNRVPNAQILTEKEYSLFCDLMNDIDELVKEKVFNYIPISNNEFITALETSIKPMYLFNISNKDLSYADSFKKGIRKSRGTENLHTLYFKALMEGDQNIIDIGTGSIFYRKGELKYTEEKLKNGHHAEILKDKFPYPIIKDKRYVYDKFLLHLSIVQNYKYPKADKVDINNKVREYIKENNNLHIIGIDRGERHLLYLTVIDLQGNIKEQYSLNEIINNYNGNTYKTNYHDLLTDREEKRKKERQSWKSIENIKDLKEGYLSQVIHKITELMVKYNAIVVLEDLNKAFKGSRQKIEASVYQKFEKMLIDKLNYLVDKKKLPKDTGGILNALQLSNDFNQDKIDKSKQSGFLFYTQAWNTSKIDPVTGFVNLFDTRYETREKAKDFFKKFDAICYNAEKDWFEFSFDYNNFTTKAEGTRTNWTLCTYGKRIESFRDEKQNSQWASNEINLTEKFKSLFEKYNIGFNDSLKESIVAQDSAEFFKGLLTLLKLTLQLRNSEINSEVDYLQSPVADNNGVFFNSQECDNSLPQNADANGAYNIARKGLWIVNQIKNSSDISKVKLAIPNKEWLKFAQEKPYLLND

SEQ ID NO: 453 - protein, 1314 aa, unidentified
MTKEKEFKSFEDFTNLYEVQKTLRFELKPVGKTQKMLEENKVFEKDKLIDDNYHKIKYYFDLLHRKFIKESLSEINLDFKEYYESFLSLKKGDKKTQDNLKKQEDVLRKILVENFNKKADKWKKNYKQNGIDLKKDGFEIFFEKDNLEILKREFKVKPNNDRETPDIEFIDPLTNKQKNLFESFKGFTTYFSNFYNSRRNFYSAKDKDTAISNRAINENLRRFCDNKKIFNDNKRVYEKIGVVEDEKKIFELNFYNNCLEQNGINKYNEIIGRRAKDEGGKGLNQKINEYKQKTKEKFQSFKMLDKQILGNKENDMEKFVEITSDEQVFVLLREFVKLNNSKNNQAKKLFIDFLSVQEGCELDKIYLKKSAINTISRKFFGENWQYFENALPKRETDSKEEKFKLDDFISIQTIKDALLGIQKNKKELPKKYQYLGRIVMLPKDLFKEGYAKKLADDNYQTFLNIWKSEFESCLERYEIEKEKAEKMILEEKYYEKSDMQIEKIKAYADASLAIYQMMKYFALEKGKKKVVDIKTDDNFYNNFGEYYNDYRIKDYYDEFRNYLTKKDFLGRLLFPSFRGDREQKHLLSKRIIDGAEKIKLNFDFSHDHKWGFLALLFRQNKNEYYIGIPQKGNDFKFKENKTNGKFEKMEYVQLKFKTLTGKGYIRDFKVKYSEQENQEAIVNVKTLIKKQYLDRYPLLAKVLDKKYLSKKEFGKHINELLDASYSAKFISINEDIFKINERGGLFLFKLNNKDFRTTGMPNLHTQYFRLLFEQTTPTILKLDSKIELFFRPKIKNLPIREKKDGEQMIFIDKRDKNKEKKVLQNRRYAEDKLFLHLSVIQNFSKDKIKNDTKSIKGYAKKFNASINEKILSGVNIIGIDRGENNLAYYSVIDRVGKIIENKSFNTLDVLDKDGKVAKTVDYLKLLETKAGDRNEARKNWKTIENIKELKNGYISQVVRKICDLVLKYNAIVVFEDLSGGFKRSRMKIEQQVYQKLELALVKKLNYLVNKNTQEGERGHYLKAYQLTSPIANYNDIGKQTGIIFYTQASYTSKTCPQCGFRKNVGFYFETKQKAEDEIKKLTAFKYDSQNNRFKIEYKLNSLVKEEKKNKKERDNLLFQTISKENNFVVFSNVIRYKWRDRKINEKELRRGEKVYKTEKENRGTVIEYDITECLIRLFEQNSVNYKSDDLKNAIAIKKDLSAEFYKDLFYYLFLLLNIRNSVSGADIDYIQCSQCGFDSRKGYQGCEFNGDANGSYNIARKGIMILEKIRQYKKKNGNLDKMNWGDLFIDIEEWDKFSQTINANKWNPTFKSQK

SEQ ID NO: 454 - protein, 1399 aa, unidentified
MKHYDDFTNLYSLSKTLRFELKPVGKDGKPLSDEDAEMMLKEIREQDKKIKKAYTALKPVMDQIHENIINDSLKSEEAKKISFSAYLDEYKKGKEKNLENIEKSLREKIGSTFENTANEFAKKVGKEEKEKNKKSKKEEKDKPILKEKGIKCLTEAGILKYIEKEIHKLVPDENQRKEFLDTKETIDSKGKKQVERSGHLETFKGFFTYFTGYNQNRENYYEYKKEASTAVATRIVHENLPKFCDNIIQFSSDKEIKDKKMRQIVIIPSRKNEYLNAYQYLKDANRNTQIKDAKTNTMRETHPIEEKIFDIKYFSECLAQSEIEEYNRVIGDYNLLINLYNQAKGNDPNFRKLPQFKTLYKQIGCGKNKARFFELKYDTIEEQQQAREIAAESLSVQGILELVSNAGIKYFQKKTDNIDLTTINTFTKWLKQSEHWDGVYWSKSAVDKVSNQYLANWHDIKDRIQYILENGDKEQKEILNPVASFDKKREEQLKIHDVVELSGLFDILDQGIAEGWSKFFFKESILEDRKSLIDEKLSPSQNLINLICADIEDFAKEFLEQSESISKVTDYKNETNILEIKDWLDKAKSVLWSMKYFEVKESKVKGHPINTDLANMLTALLHADDADWFGWYDAVRNYLTKKPQDDAKKNKLKLNFFNPNLLGGWSDGEEKNKGAVLLKNGHKHYVGLLIDRNIFDTKKKNISIYNSSNKDTGRLILRNIAFKTLAGKGFNGMFKVKYGDIGKTNPLEAVQKLQEFIKSYIIKKDKITYAQKYPSLKSVLEKKYNDKKIFDKEIQEILRDCYENDFTPIDWNTVLKFVEEKKMYLFEVYSKDFSTTKGDKSNNSNLNLQTIYWQNVFQENSTIQLCGGGEIFFREKATDKKIVHPANELIYRRSDGQTASKFKHDIIKDKRFTAEKYSFHIPIKINYQAPVSGIREGRPNPPAFNAVQQAVNNHFTQADDIQFLGIDRGEKHLIYYSLVNAKGEIQKQGDLDVIKNKDYLKEINEAAKIRRQKQENWQQKGNISNLKDGYISLVVHEIIEKMKDENGKFKPTFIVLEDLNSGFKRGRQKFEQQVYQKFELALAKKLNFVVDKKAPMGEIGSVAKALQLTPPITNYQDIEGKKQIGIMLYTRANYTSVTDPVTGWRKTIYLKTGSEGFIKEKILEAFTEISVDEHGDYFFQYKDRNTEKIWTLWSSKNGKPLERYRAKRSKDKNKYEVESIDVKEILDKLFADFNKNDSLIKQLREDKELLKVNEHTAWESLRFVIDTLQQIRNSGDTNKKQENKFFGADESKNQDDNFLLSPIRNESGEHFDSRIFEKQKDPKLPKDADANGAYNIARKGIIMYEHIKQWVVEGKEKSDLDLFISDEEWDLWTVDREQWKQKLKVFASQKAKKENAKRS

SEQ ID NO: 455 - protein, 1358 aa, unidentified
MKDKDIFSNFTNQYQLSKTLRFELVPIGKDGKQLAAEDAAKLFRNILKKDREIKEAYIALKPFMDKIHEQVINRSLTSDEAKQIDFSKYFEKYKHKEEIVSEEKSLREAIVKTFNAGTQPLKEKAGKDDKGKPILKKEGVKCLTEAGILKYIKNNIRELTDDENERKELETHLKTFEKFFTYFSGYNQNRGNYYSKEEKATAVATRIVHENLPKFSDNCIQFRDGKVQEKKKKSQNAEEVPHSRKDEYLNAYQFLKDANRTTQIKDAKTNEMIEAYPIDEKMFDIGRFSECLSQSGIEEYNRVLGHYNSLINLYNQARRAEKDFRELPPFKTLYKQIGCGEKRALFHELKYDTKEQQQAANKDTNEILNLEDTLKAISMAGKKYFGNSAQEGDTQTIQKFIAWLKQTDDWNGIYWSKAAVDKVSDKYFANWHGIKDLLKGNKACVYIDKNKELQINDAVELSGLFEVLNQEGDKGWSEDFFRKSILEDRQSLIEEKLTPSQNLINLICADMEDLAKDFCDKSADMLKITDYKNEDNILKIKEWLDTAQSLIWLVKYFQVKEGKVKGNPINPELSNMLTSLLYSDDAQWFNWYDAVRNYLTKKPQEDAKKNKLKLNFENPILLGGWSDGEESSKGAVLLKNNNKYYVGILIIRSIFKTTKNNNPIYNASDDNIGRLILKKLDFKTLSGKGFKAKFKEKYGDIGKRSQKEAIKKLQEFMIVHKRDKDKKTYIEKYPLLSKITNKVFADKKAFEAEVNEILGECYECDFTPIDWNVVLKYVSEEKLYLFEIYSKDFSERKGEKSKNSNVNLQTKYWEHLFQDNSPIQLCAGGKLFFREKAIDDNKKIFHPANQPIYRRSDGKIVSRFTHDIVKDKRFTTEKFFFNIPVKFNYQSPVRGFIKGKVNPIAISKVNGEVNNRFTQANDIQFLGIDRGRKHLVYYSLVDSKGNIIEQDHFDVINKKDYLQEINEAAEKRRKKQENWQQKGNIKNLKDGYISLVIHEIIKKMKNKQSGEFKPTFIVLEDLNTGFKRNEQKFEQQVYQKFELALAKKLNYLVDKNVPTGEIGSVAKALQLTPPVANYQDIEKRKQVGIILYTRANYTSVTDPARGWRKTVYLKKGSEQSIKEQILSTFSEIGVDKQGDYFFQYSDENTGKTWSLWSSKNGNSLERYRARRGKNKNEYIVDPYSPKKMLDQLFKNFDKQKSLLEQLRNGNVSLSKIDDKNTAWESFRFVIDLIQQIRNSGDAAKGQDDNFLLSPVRNEHGEHFDSRNYQKQENPNLPKDADANGAYNIARKGIVMFEHTKQWIKDGKQKFEKSTDLDLFISDKEWDLWASDKEQWEKQLQTFASKKMKNGNLHPHIIS

SEQ ID NO: 456 - protein, 1259 aa, unidentified
MKEFTKQYKIAHTLTFELKPIGKTRERLEESGLLKQDFKRAEDYKKAKDFLDELHKKFLQDVLVEIRDINWMPLAEQLENFRKNKDLKKDLEKVQESFRKELSSRFTSNGFYKELTEATPSKLFKNLEKSGMLPDEIKTFSRFACYFKGYQENRKNIYSVQPQNTAAAYRAVNENFVKYANAVDIFERFYSMRPELLAQIAEKCADLIGDGKLADLLQINNYNNFLSQSGIDTFNKIVSEVNYAVNLFRQAHKEIPAKELPFLPVLFKQILSDREHAFALKEFKDDVALFCELKSFIDFISAVEIHGETVDLPVSLQRLFSTLTEDDLLYVNANSLSDISHKVTGRWDAIQDAMAKYSQRTFSTKKLQEKYCKQPVFSFNDIKAWGLVRIGGEEGDPIPVQFTDFWQNENVAALFSQEAVLRPQVLTVIQKESALSLRKRENDVDLIREYLDTLQNIFRLLKPLVVESEYGGDIDLLGILTEHYNKLENIIPLYKQTHNYVTKKIIAADKIKLMFNVPTLADGWDVNQERANAAVLLLKDGAYFLGIMNPKSKVDFEKYATSDTENCYQKMVCKLLPTPYRMLPKVFFAQSNIDFYNPSPDLLQKYKEKQHIQGSNFDLDFCRELIDFFKVSIEKHPDWSKLGFMFKETSAYTRIDEFYREVETQGYKVSFANISADIIDQLVSEGKLYLFQIWNKDFASGTHGTPDKFTLYWRALFDERNLSDVVFQLNGTPKLFFRETVIKSPAKHQVGEKMVNRTIIERFEGDCAIRTPIPESIHDEIFRFVNGRLEEELSSEAKKYLSDYPRLDWKVGDDIHCAEKRIVVKDVTHEIVKDKRFTKEKFQFHVPITVNFKSGDAFKFNDKVLEYLRNNPDVKVIGLDRGERHLIYLTLMDQQGNIIIQKSYNTLNGVEYHKKLDQREKERDNARKSWKSIGKIKELKDGYISGVVHEIVSMMVAHKAIVVMEDLNVGFKRGRMKIEKQIYQKFERALIEKLNYLVFKKTEDPLAPGGVLNGYQLTSKFESFKKLGKQCGFLFYVPAGYTSKIDPTTGFTNLFNMKNCTNAENRKAFLEQFDSIKYDALRNAFAFSFDYKNFKTGQTSWKTDWVVYSAQRRWTFSTRENKNCEIKPTQIILEALAKRDVCVADGFDLLSYIKSVEPNSANAAFFSDIVFAFDRTLQMRNTNGEKDYIESPVLNRKGEFFNSETTDASLPQNADANGAFHIALKGLYLLKKVIPGSTGKINFKIEHKDWFEFAQKRNI

SEQ ID NO: 457 - protein, 1364 aa, unidentified
MSSHKQDKEEGIFDSFTQRYALSKTLRFELRPVGKTEALLKEHQVFEKDLTIDASYRNAKFYFDALHRDFIREALSEEHAKGLPFGALEDGFVRYQSLPKKEQRYDPKWKDAQKVFRQSIVALFNQTAENWESKKYAHLFKKKKKGEDDELENEEKSKGIGFIYSKNILPILKERYPKESDAQEQERGNPSLFVEQEDVSGEQRYIFDSFDGLTTYLSNFQETRKNFYSAGGEATAVASRIVQNHLLFLRNQHLFQTYLAKNAENLGLSDQDTVIFSDGYHAGCLLQEGIREYNLVIGSINKRVKELRDQRKSESKTTKKEYCESDYPMLARMKKQILGEVQKHEELITDNKGCLEHFRLFCSETEKRIEEANALMVDLFRGNFSEGFDSIYLNHKALNSLAHVFLSDEQTFLVSLPQRTKKVNPEDPKIAFFISLQDISNALESVKLGMQNGNGDQKPARVFKNRFYESRGKVPAFFDEKDSRSLIEQFLALIEHDWKALFENKLDENGLTERAGFSEALKAAHEYLSRADEGSEDRKEQVAIMKGYADAVLSVWQRLSYFSLEAKNLDDIPTDEDVIFYDRFSFSYEGSSIDIVRSYNAFRNFLTRKPDEKDKLKLNFGKGNLLDGWAESPEGNAQFQGYFLRREGAMYLGISSSSHYLDHVRYPEIGEDTENGYEKMEFQSLDWGKNIVGGQVYPSYTREKLGKRLSFKEHKAVFITPRDHAEFLRELIRDKYVSRYPQLTDFLLQEFESPNVMREAFEQIPVGGITFRKISRDWVEKQCIEETGKKNKNKQLPTLYLFEISNKDLKKKQGQEGMKNIHTLYFERLFSPESKSALDLLGGAEVFFRRPFEKERLLVTTLKNQRTIAHATRLGRYTEGKYLFHLPIGINTAAGKAKSFNQKLNNLLKQKGEAVNIIGIDRGEKHLAYYSVIDQTGNILDSGSLNTIEQKTRGGVLIVDYYTKLRTLEKERLINRQSWEPVVKIKDLKKGYVAAVVRKICDLAIEHNAIVVLENLNMRFKQVRGGIERSVYQQLEKQLMDKLGYLIFKDRESNEIGGALNGYQLAAPFESFQKLVNQTGIMFYTQAAYTSVTDPLTGFRKMFSLKSSWSQKKILDNITKFQSFAWDEAKKSYFFTYNQADFSGEKRKKAKEILSKEWTVYAKVPRIRRELRGGYWQTDQVDPNTLLEELFRLWEFDHVHGDILDQIQERASQKLLGGERPFMGKSRGFFSSIAYIIDGLILQLRNSASKQFVKNKEGTYEEVGADIDFIASPVEPFFATIAAGYVDQSRLSEFEKRYRGVITKKEVFLSTFNGDANGAYNIARKGAIILKERISKNPDKPDLYIGNDDWDRFVQKQYDDEQKK

SEQ ID NO: 458 - protein, 1333 aa, unidentified
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNTNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLNANLLGGWSDGEEKNKGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFFFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 459 - protein, 1417 aa, unidentified
MKNFDDFTNLYSLSKTLRFELKPEGKTEKTFKDWLEELKSMEPASGTDGNLFIKDKKIKEAYLAIKPIMDKLHEQFIEMSLISEEAKKIDFSEYFEVYNSAKEKSKKKRKDEENTDEDNKEQKKNITDIENALRKKIAETYEVSGNYYSKKIGEVIKKVEEEKKKGKKGKTKDEKPKNQKTKNSYECLTDAKMYNYLLANVKDLAKQNDIDEELLAKHIEQFKGFWGYLTGYNQNRENYYEVKKEASTAVATRIVHENLPKFCSNIRRFENRQEEYLAIYQYLKDYKRETKIKDSQGNECEAEAIAETIFQIKHFNKCLAQSQIEEYNRVIGNYNLLINLYNQARRGENDFMKIDKFETLYKQIGCGKKKTLFETLQDDTDVKNLLQKAKDVGDVMFKITISQKDENDEIKTIPDFIQFLKKCDTWDGIYMSKMAISKISNQYFANWHSVKDKLKEARANACITYDKNREEQIQLHDAVELSGLFAVLDTEQSEHFFKESLFKDDATNEYRDVLDKSLTPSKNIINLLCFDIERNIKAFLQESDSIVALEKYKDENIKAGEEDQTIKQIKNWFDAATDAMRIVRYFAVRKSKMKGNLPNVTMEQALSNLLYNDDAQWFKWYDLIRNYLTKKPQDDAKENKLKLNFGTSSLLDGWSDGQEKNKAATLLKCDNELYLCILKTKSVFDTSKEDNPIYQVAQSNASRLILRNLKFQTLAGKGFLGENGISYGDMGKNDPTKAIQCLQKIIKERYVKKYPLLEKFVVNTYSDKSKFDAEITEILKECYVCEFVPIDWSLVTEKQNNDELFLFKIHCKDYQPNTTGKKDLQTMYWEDVLTDGSKHQLCAGAEIFMREPVAETSPLQHSVGSKLVNKRDKDGNTIPEQVYREIYSFVNGNGNTKNISTKAKEYIDEQKAIIKDVKHEIIKDSRFYGEEPKYMFHCPIKLYFEAKDPKYAFPEVNAKITDMLQQSENLQFIGIDRGEKHLVYSCTIDKNGKIIKGKCNHHDNINGTDYVQKLEAVADERIIAKKNWQAQNKIKDLKNGYISHVVHRLVEETIKDGENIAPHAYIVLEDLNTEMKRGRQKIEKNVYQNLETALAKKLNFVVDKNAKYGELGSVSKALQLTPPISSYKDIEGKKQFGVMLYTRANYTSVTDPATGWRKTIYIKNGSEEHIKTQILKEFSDFGFDGKDYYFEYTEKHAEHTWRMFSGKDGEPLLRFRNSKQKQEDKNIWVPESVNVVEILNTLFSGFDKNMSFKEQIEDGVELKKIDGRNETAYQSLRYALDLIQQIRNSGEKNSNDDNFLYSPVRNKNGEHFDTRNSENNGDLSEIRDADANGAYNIARKGLIMDAHIKHWIEKGRPKTKKDGKDVPDLDLFISDEEWDLWLLDREQWRKELPTFALRSAKEDDSNKSKAGKGKKKK

SEQ ID NO: 460 - protein, 1484 aa, unidentified
MNNMLSEFTNKYQLSKTLRFELKPIGANGQRLSEEESSHLFKDIIEQDRKIKDAYMALKPVIDQIHEDIINKSLTSDDAMSIDFSPYFKEYKNVKEKKLDAIEKELRAAIGSTFVQTAKSYTVTKTTKKKEDEKPVFEIKKNKPPMVQAEIVDFLLEKYKDNKELIEHIKGFKGFFGYFDGYNTNRANYYEFTKEANTSVATRIVHENLPKFCDNAIQFEIGKVQKKKNKDSEKEILPISRKDEYLNAYRFLKDNNGDTKIKDRKSNNYIEAYPITEDIFAIENFSNCLSQVGIEEYNRIIGHYNMLINLYNQTKKSEKDFKKLPPFKTLYKQIGCGEKKNVFEKIGNDEELKNTLDKISEAGRKYFVKQTDESITTIHTFTKWLRENEDWDGVYWSKVAVDKISNQYFADWHTIKDRIQTVLQSKGKEQKELKESLKAVATFDKKREEQLKINDAVELSGLFEILNQETETGWSKMFFKESVLEERKSLMDENLTPSQNLINLICADIEELAKSFSTNCSEILDKEKSNKQKEVKKTIQILEITDYKHEDHILAIKEWLDTAKSVLWLIKYFEVKESKIKGNSINSELSNMLSELLKANDTDWFDWYDLVRNYLSKKPQDDEKKNKLKLNFENSNLLKGFVDSYSESDNATQYGSYLFRKKIEGKENEFEYFLGISRNAKLFRCHLQDTIQVKDKSEYERLEYYQAKPTTYFDAKYNNNKDALVNEIETLVNEVVRNNEQLKADAEKIKKRDKDGKITPTTLIDRIKKQDEFKPILNNEVVVTFVQKTIEDLKTNTTNFIARAPKLQEIKDKEYFGIEGLKQIIDDLQTIAKENKVFNFFNVSKKEFDASFIDEKKPLYLFKISNKDLNFSETSRKDEKGKQKRTFKGNENLHTILFKALMREFEGCETIDLGKGEIFFRKSVEGIKKEPTHNVGDKMLNRREKNTGNTIPNKIHNELYLLANNKIGIKDISNEAKAYLNKDNKIDENRVIIKEVKHAITKDKRFTEPKYQFHLSTILNFNPKKEDINETVNENFIKADDIRFLGIDRGEKHLIYYSLLNANGKMISQGHFDCINNKDYLQAINDAADVRKRKQENWQQKGNISNLKDGYISLVIHEIIQKMKGEDGNYKPTFIILEDLNTGFKRSRQKFEQQVYQKFELALAKKLNYLVDKNVKDVSQIGSVANALQLTPLVSNYQDIENRKQVGVMLYTRANYTSVTDPATGWRKTIYLKSGSEADIKKQIVGTIEGKFEDGALSEIGFDSNDYFFIYTDKNTGKEWKLWSGKNGTSLERYRFKRGNSKNESVVESIEVKPLLDKLFEKFDKSKSLKQQIENGIELQKTNEHTAWETLRFVIDIIQQIRNSGDTAKNQGDNFLLSPVRNEHGEHFDSRPFEKIENPKLPKDADANGAYNIARKGIIMYKHIKHLGKNWNRKVKIDGNDTIDLDLFVSDKEWDLWLTDREEWKKNLNYFASREIKTNPINHE

SEQ ID NO: 461 - protein, 1399 aa, unidentified
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNTNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGKGDFLNGFVDSHTKKKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYIFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 462 - protein, 1340 aa, unidentified
MNKTAEKTLKNFTNQFPVSKTLRFELKPIGETLEYIKVNNILNEDRIREENYQELKKVLDREYNDMLTRILKNFETDWINLADALTLNSDVVNRREIVNEEKEKVAGKLNEHIRKNTKNMFTEKFLKAVLEYEDITDRERQLIEHFKGFSTYLTTYFQNRENIFLETGKGVSAINRIVNENFPRFLDGVKNYKKIINNEKVITEIRDNIRKNEEFGVDDLDEFFKVENFNNLIDEDGIERYNALIGGFTKESGKKIQGLNEIINEYNQKSVSKIKRFTALYKQPLSPKNTISWVPDIIKDDEELFDTINGYLETIPEKFTESIESLYNNCIEKNNFAIKIQLLNNISNAIFKDWSYLNQKIEEKLVRENQQEKGEKSLSKKEKEKIKKSLEESASNKISMYEIKNSISEDEYDSVTLWLKSEAIAKAETAQKEKEKYVTNISRGAKIKGNDRNEESVKQLLESFNELLKFISHHELKLGDDNQTSFQESLEILSSVNLVYNKARNYITKKEDVEDKIKLNFSTPMLGSGWSKSKERENLTIILRRKINGKYMYYLGIMKKKEKIDFEEMISEDAETYEKMEYFLFPDAAKMIPKCSITTKEVKNAFEKNGKNEIILSGGNFTQPLKISRELYELYNPSYCDKEGEVYEDKTFTTKFIRNKWINPELEGIGSEEKKLKENDKYKLDVYKEALAKWIDFSKDFLSKYKGTSIFDFSHLKKSEEYRALDEFYNDINKAAYKIEFVNLSKNKIDRLVEEGKLYLFQIYNKDFSEHSRGKENLHTIYFKEIFSEENLENPIHKLSGGAEIFYRKKSEKNSFSHKKGEYLVNKTYFSQEKDGKKIYKNLPEELYMDICKILQECKKTDKKYDKDLEICVKKWNKSHKGDIEIKTEQIEINRAKYEIKKDKRFFENKYFLHVPIEMNFVAENGKNKLNSRIIEHLIKNKDGENAKEIKYLGVDRGERNLISLCLVNSKGEIEHQENINLVETNRNGKGIINVDYNEKLSSKAKTREEERKNWKSISNIRNLKEGYLSGVVHKVAKMAIEENAIIIMESLNTGFKRSRQKIEKSIYQKFEKMLMNKLSFLVEKNIQMGPGSIREPIQLTREFKEEKDLKGHNGIIFYISPFWTSQIDPATGFVRNFKEKKNGRKIRVITEDSLLSLRYISPEEGFKFKIDFSKMERIFELKNNIWEIYTIGEKFIFNSDRKSIDIVNVTEKLEAVFNSENIEYKESQELREIVLENKKLLKTVDCWFKERTKLRNKNENQDFILSPVKNSAGKFFNSKDDFEGLPKDSDLNGAYNIALKGKFKIEKTAEKYKDGKINLYKMNDSEWLDDYQKRLYFKH

SEQ ID NO: 463 - protein, 1393 aa, unidentified
MNELQEFTNLYPLLKTLRFELIPEESTRKRFQEWLEELDNKNKSAVETTSTNIINGENLILKDKRIAAAYIALKPVLDKLHEEFIEVSLSSDEALGIDFSSYWEAYQDKKVTSDRENALRAAIGKTFQAGIDYFYKNFVESEVKIKEKNKNRPLFSENILSYIDKKAVQYTSNDLTEEELKMHLNCFKGFYTYLSGYNTNRRNYYETKNEKSTAIATRIIHENLPKFCNNIIRFYNRKEEYLKIVDWLKNKEKVTQIKNAEKGLFETVEPICEKYFVIGYFNHCLTQKQIEEYNRIIGNYNSIINLYNQVKKQEDSNFKKLDEFVTLYKQIGCGRNEYYFPALIAEKTSELTEKQKQSGAILSIEQLLQAAKKAGDKYFNTKGEKEISVIDFIDFLSSCTDWRGIYWSKSAITSISNRYFANWHDIIDKLKDKEACATYDKKREVPVQLRDAVELSELFEVLDSESPEYIFKDSYVEGTIINNHRYQIDIKISTSRNLINLLCEEIKNHISDFLADSYNIVTLQAYRQKDINDNGEDLIIKQIKNWFDCATDAMRIVRYFAVRANKMKGHTANAEVEKFLDALLRNPSTDWFGWYDLIRNYLTKKPQDDVKDKKLKLNFDNGLFLNGFVESKTDKNDHGTQYGGYIFRKKHVACNEYEYYIGVSTKTKLFRCHLRDNIENTDKSDFERLEYYQMKSTTPYPNEYGEKKLAIQNIVKELIISISDTKQKIEEANKITNKIPDKDLTPNDLYRKISTSQNFQHLLKNERLLNEVNSCIQLILNNCARFTKMEAINSLQKNSYSDWEGLTQLINDLKDITNSRNFDFFPISQKEFEVHNGKDLFLFKISNKDLSYCENYSKGYRKKKEKQKENLHTLFFRALMHEDGFGDTVDIGKGEIFFREKAFDYDNYIWEKGHHAEQLKGKFSYPIISKKRFAQDKYLFHLSIFLNYKATTKEKEVEEKLKEAIQKIENMNFVGIDRGEKHLVYSCIIDKDCNILKCQHHDNINRTDYVQKLDAIASSNIIAKKNWQQQDGIRNLKEGYISHIVHHLTNCVIKDETGKINPHAYIVLEDLSVEMKQSRRKVEKQIYQKLETALAKKLNFIVDKEAKNGDIGSVSQALQLTPPLKTYEDIKNEKQFGIMLYTRANYTSITDPATGWRQTIYLKNGTDREIKNQILSKFDDFGYDGTDYYFEYTEEHAGKTWRLYSGKDGKSLPRFRNNKQKEADYAIWVPEQIDVVNILDQIFVDFNKTKSFKKQIENGIALHKIESKKETAWQSLRYAIGVIQQIRNTGINSHDDNMLYSPVRNEDGIHFDTRNAINNGPLSLIVDADANGAYNIARKGLIMDAHIKYCLQEKIPSNSVDLFISDKEWDLWLLDRDEWKKQLPSFARNSNKK

SEQ ID NO: 464 - protein, 1247 aa, unidentified
MLNYEDYTKRKQVTKAIRFELIPTETTQKNLEEHEILKQDQALYAALDRIKPIVDSFIKDITNKALKELTYDFNVLKDAKEEGRKAYDKAEKELFKAIDKSVSESLPKELSVSKINSAKFLQDSLTEYVLNTNDKSIKKDEAIKDIETTKGCLALFSKFLTTRITALTVWMPQRVVENFNIYCSNIEKIKNVLENAEFDSTDFQDELIKMVNVSYYEQVLTQTDIDGYNSIIQGNSNEEGIVFKGLNQRINEFNTRIRNEKRDVRALRKLDMLNKQILTPQEKKFKIETITSDDEVRSVIKTSYSSFSEASKALATLLLEKQMDSDGAGIIIKGNKLHQLSHLLTGNHTKITDAIVQEESNAINKMLEDETLKPSMRRELQKRLEILPSHIIKSNYEMTALDKYLVNEDKSVIAEQKSTFSAYISEYNNAVKTVHTYYSILEGGDVFKSRKIKGNRHMQEMIADFFAELTAVRDILFLINLPNDEDGDFAFYDTFDELYDAIRNTYKAENLVRNYLTKSVKDTAEEKQTCLGSPARLRAMWWNGEKKFSKDLATIIKHEDKYYYFVLSEDAKPITVAEVEDSKTSFLTFKKGQKSFMMLPKILFKDHATPFFENNKTAEEYVLDDECVSKSIAIDRKIYDIYKDGLFKREAVTGGLITEDEYKKNIAMLIDTYKLFANAYVQYSKFDMTQLNDTDSYADIGEFFSDVDIYTSKLSWTSIDFKQIENLVEHGQGYLFLISNRFLYAGKADKNPYSKVFLSILSDENMKKSTILLNSNPSIYYRPRILESKITHKTGSFLVNRLTEDGEPIPKAIYETIYKLKNDFTNIADEDIKEAKEYMNTHKVIAFKSGKDVSYQKRYMQDKYILQLTYTKNNDISDRTIDMLNDRIIEAIEDGYNVVSISRSTNDLVYISVFDKDFNVIEKRSLNKIDGIDYYALLKDAYKDKKEDKKAWIYDTSSGNLKAAYIDCAITEILKVAKKYNAIIVVESLSDRFKDKYSFLDNQVFKTFETRIAERLFDLSFKDVKSGRAGSVNNPLQLANNSGNSYQDGVLFYVNNSFTRGLDIKTGFTNIFATDRIKSIQAKRQFLAKMDNIEIQDNKITFSFDYANYDTRFETKKTKWSTIFNGEAVVYDREKKTNTRVENVITDEIIPAAGIADITGNVAEKIIDKQIPGAFVETLYKWFIYSINGIQKKTAKSDEIYRSPITGEDYAVNEVTTYNLARKLVFRLQYDGSSENFNSEWLNYVQQ

SEQ ID NO: 465 - protein, 1307 aa, unidentified
MKAKYMNYQLLFQKFVHLYPISKTLRFELIPQGATQKFITEKQVLLQDEVRARKYPEMKQAIDGYHKDFIQRALGNIDSQSFEQALQTFQELFLRSQAERSTEAYKKEFETTQTKLRELIVNSFEKGEFKQEYKSLFDKNLITNLLKPWVEKQSQTGDNNYTYHNDFNKFTTYFLGFHDNRKNIYSKEPHKTALAYRLIHENLPKFLENNKILRKIQNDHPALWEQLQALHHTMPQLFNGWDLSQLLQVSFFSNTLTQTGIDQYNTIIGGISEGENRQKIQGINELINLYNQKQDKKNRVAKLKQLYKQILSDRSTLSFLPQQFADDAELYHAINMFYLDHLHYQSMVNGHSYTLLERVQLLINELANYDLSKVYLAPNQLSAVSHQMFGDFGYISRALSYYYMQVIQPDYELLLASAKTTAKIEAIEKLKTAFLDAPHSLVVIQAAIDKYLQLQPSSKPHTQLTDFIISLLKQYETVADDQSIKIINIFSDIEGKYSCIKGLVNTESTSESKREILQNEKLATDIKAFMDAINNVIKLLKPFALNEKLAASVEKDARFYSDFEEIYQALLVFVPLYNKVRNYITQKPYSTEKFKLNFNKPTLLSGWDANKEADNLSILLRKNGNYYLAIMDTAKGANKAFEPKALNQLKVDDTTDCYEKMVYKLLPGPNKMFPKVFFSESRKAQFNPPQHIIESYNKKEHISSEAHFDLKKCHALIDWFKQCIELHEDWKHFNFKFSPTSQYSNISDFYKEVSEQNYKVHFQDIPADYIEQLVAEGKLYLFQIYNKDFSPHAKGKENLHTMYFKALFSEENLKQPVFKLSGEAEMFYRPASLQLENTTIHKAGEAMVAKNPLTPDATRTLAYDIIKDRRFTTDKYLLHIPISLNFHAQESMSIKKHNDLVRQMIKHNHQDLHIIGIDRGEKHLLYVSVIDLKGNIVYQESLNSIKSEAQNFETPYHQLLQHREEGRAQARTAWGKIENIKELKDGYLSQVVHRIQQLILKYNAIVMLEDLNFGFKRGRFKIEKQIYQKFEKALIHKLNYVVDKSTQADELGGVRKAYQLTAPFESFEKLGKQSGVLFYVPAWNTSKIDPVTGFVDLLKPKYENLDKAQAFFKTFDSIIFNAKKDYFEFKVNLNQFAGLKAQAARAEWTICSYGPERHVYQKKNAQQGETVIVNVTEELKALFAKNNIEVAEGVELKEMICAQTQVDFFKRLIWLLQVLLALRYSSSKDKLDYILSPVANVLGEFFDSRHASTHLPQDSDANGAYHIALKGLWVIEQLKTAANTEKVNLAISNDEWLRFAQEKLYLT

SEQ ID NO: 466 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNRNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFENSTLLNGWDLNNERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFQLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 467 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNKNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFENSTLLRGWDLNNERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFQLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 468 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNKNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFENSTLLNGWDLNRERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFQLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 469 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNRNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFENSTLLRGWDLNNERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFQLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 470 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNRNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFENSTLLNGWDLNRERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFQLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 471 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNKNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFENSTLLRGWDLNRERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFQLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 472 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNRNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFENSTLLRGWDLNRERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFQLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 473 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNRNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYIALYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFENSTLLNGWDLNRERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFQLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 474 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNKNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFERSTLLNGWDLNNERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFQLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 475 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNKNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFENSTLLNGWDLNNERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFLLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 476 - protein, 1252 aa, synthetic construct
MKKFDDFTKIYPLSKTLRFELVPVGKTLESIYESGILEQDTHRADSYLKVKKIIDEYHKDFIERVLGNLKLVYEDFGKKNSLKEFYSSYMLVSKDKSKKPDFERIQDALRKQIADAFKADEKFKNLSKKELIKDDLREFVSTAEELALVEEFKDFTTYFVGFNKNRKNMYSAEAQSTAISYRLIHENLPIFINNMGVFEKVALSPVAENFSELYSELEEYLNVCKIQEMFNLDYYSNVLTQKQIDVYNLIIGGKSFEDGRKIKGLNEYINLYNQQQKEKALRLPKLKPLYKQILSDRNSISWLPEQFQSDNEMLEAIEKSYQSLYNNVLNKNVPGEHSLKELLLSLSNYDLDKLFIKNDTQLTDISQKIFGNYGYISKCLIAELKNSVPKKKKETDEAFDERCTKLLKLQDSISIRTINNCIENASEVNVKTLESYFANLGAFVSNDVQTENLFQQIENAYIAAKDLLNTSYPSDKNILQDKYSISLIKNLLDAIKTLQYFVKPLLGTGNEADKDEKFYGEFSALWSELEIITPLYNMVRNYVTKKPYSKDKIKLNFERSTLLNGWDLNNERYNTAVILRREGLYYLAIINKKHNRVFEEKNIRSNGDCYEKMEYKLLPGANKMLPKVFFCKKNIKEYAPSEELLNNYKNNTHTKGETFNLSDCHSLIDFFKSSINKHKDWKNFEFNFSETKTYNDISGFYREIEQQGYKITFRNVSVDYVNQLVEEGKIYLFQIYNKDFSLYSKGTPNLHTLYWKMLFDERNLNDVVYKLNGEAEIFYRKSSIKYEKPTHPANHPIDNKNPLREKKQSLFNYDLIKDKRYTVDKFLLHIPITMNFKSLKNDNINSAVNEYIRECRDLHIIGVDRGERHLLYLTVIDTKGNIVKQYSLNEIVNSYKGNEYRTDYHNLLSQRENERLKARQSWQTIESIKELKEGYLSAVIHKITELMVQYNAIIVLEDLNKGFIRGRQKVESSVYQKFEKMLIDKLNYLADKKKQPEEPGGVLNAYQLTNKFVSFEKIGKQCGFLFYVPAWNTSKIDPVTGFVNLFDTHYESIDKTKSFIEKFDNICYNKERTYFEFSFDYAKFTTKANGTRTYWTLCTKGKRIETYRDERQNSNWVSREVNLTEEFVQLFKDFGISVDVDLKTAMLTQSNATFFKRFMYLFKLLLQMRNSKSGTAIDYLQSPVADENGYFYNSDTCDASLPNNADANGAYNIARKGLWIVQQIKASKENDKLNLVISNKEWLQFVQTKPYI

SEQ ID NO: 477 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHRNRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFENTQLLKGWDLNKESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFQFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 478 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHENRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFENTQLLRGWDLNKESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFQFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 479 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHENRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFENTQLLKGWDLNRESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFQFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 480 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHRNRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFENTQLLRGWDLNKESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFQFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 481 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHRNRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFENTQLLKGWDLNRESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFQFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 482 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHENRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFENTQLLRGWDLNRESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFQFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 483 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHRNRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFENTQLLRGWDLNRESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFQFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 484 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHRNRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYIALYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFENTQLLKGWDLNRESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFQFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 485 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHENRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFERTQLLKGWDLNKESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFQFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 486 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHENRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFENTQLLKGWDLNKESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFLFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 487 - protein, 1266 aa, synthetic construct
MTDLSYFRQLYQLAKTLRFELIPLGRSLEFIKANGLLSQDEHRSKSYISMKKIIDEYHKKYIEEALSDFKLEIENKGEKNSLSEFFSYYNKRNRDEADQKAFDNIHDNLRKTISKQLKNSEIYNRIDKDKLIKEDLMMFVKSDESKIELIKEFQNFTSYFTGFHENRQNMYSEEAKATAIAYRLIHENLPKFIDNMAVFEKVCKVPELYENTKTIYEDFKSYLNVKKIDELFQLPYYSMLLTQKQIEVYNFIIGGKSEGKEKTKGLNEYINLYNQKQKDKSNRLPKFKQLFKQILSDRESISWLPEKFNSDNELLEKLECCYHNFASSNDGALSLFKKIQDLLLSLSEYDLNKIYIRNDLQLTDISQKMFGNWAVIQNALLENLKRSVSQKKKESNELYEERLNSSLKSKDSFSIEEINSALNNYNIENSPMSVCTYFSNLGEKKSDSDSAGNVFVTIDNAYKEIKALLNSPYPEDKNLAQDKLNVEKVKNLLDAIKDLQRFIKPLCGKGNEAEKDERFYGEFIALWEELDKITPLYNMVRNYLTRKPYSVEKFKLNFERTQLLKGWDLNKESDNTCVILRKDGLYYLAIMNKKNNKVFESKNLKSNGKCFEKMEYKLLPGANKMLPKVFFSKSRIDEFKPSEQLLKNYEKGTHKKGANFKQEDCHALIDFFKRSIEKHEDWKNFSFNFSDTQSYEDLSGFYREIEQQGYKISFRNVSVDYVNSLVDEGKIYLFKIYNKDFSPYSKGTPNLHTLYWKMLFDERNLSDVVFKLNGQAEVFFRKASISHDKPTHPANQPIKNKNILNKKKTSTFEYDLIKDKRFSQDKFLFHVPITLNFKSTGRDNINPTVWEHIRKSEDLHVIGIDRGERHLLYLTVIDMKGNIKKQFSLNEIVNEYNGNTYRTNYHDLLAKKEEERDIARKSWQTIENIKELKEGYLSQVIHKISELIVEYNAIVVLEDLNMGFMRGRQKVEKSVYQKFEKMLIDKLNYLSDKNKVPEAEGGILNAYQLTNKFESFEKVGKQSGFLFYTQAWNTSKIDPATGFVNLFDTRYSNVENARKFFDKFDSISYNSTKGWFEFEFDYSNFTAKADGTRTKWTLCTYGNRLENFRNPGNNSNWDNKEVDLTAEFNKLFDKFNISLNSDLKTEIAKQNSKEFFEKLLHLIKLTLQMRNSKIGTEIDYMQSPVADKNGVFYNSDNEKQKGKDAEGNWIATLPVDADANGAYNIARKGLWIISQIKKTENNEKPNLAISNKEWLKFAQERPYLED

SEQ ID NO: 488 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHRNRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFENSTLLDGWDVNKEPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFQFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 489 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHENRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFENSTLLRGWDVNKEPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFQFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 490 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHENRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFENSTLLDGWDVNREPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFQFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 491 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHRNRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFENSTLLRGWDVNKEPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFQFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 492 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHRNRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFENSTLLDGWDVNREPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFQFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 493 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHENRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFENSTLLRGWDVNREPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFQFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 494 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHRNRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFENSTLLRGWDVNREPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFQFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 495 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHRNRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYIALYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFENSTLLDGWDVNREPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFQFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 496 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHENRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFERSTLLDGWDVNKEPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFQFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 497 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHENRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFENSTLLDGWDVNKEPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFLFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 498 - protein, 1278 aa, synthetic construct
METNFFKSFTKQYSLSKTLRFELKPVGKTLANIETKGLLKQDSQRAASYKEMKKTIDKYHKDFIELALKNVRLTKLEGYCELYSKSKEDRDEAAYKKVKEDLRKEIVRAFSSGEAKEKYKNLFAKELIKEDLETWIKQQENRDELYFDERFKNFTTYFTGFHENRKNIYSDEEKSTAIAYRIIHENLPKFIENIKLYQSIKEKHHDLDFSPILTEMEEVIQGKSLDEIFSLEYFNNVLSQNGIEFINFIIGGKTPEVGDKIRGLNEYINLYNQQQKEKNKRAPKFKQLYKQILSDRTSISLRFEAFENDSELLEAIEVFYQNELCEFETEGKQKNVFGEIKTLCETIPAYDTEKVYLRNDTGLTNISQRIFGTYSVFRDAISFYYDTVIDPAFQSKYAKAKTDSQVKKLTDTKNKWNHDFISIGLLQKALYKYIETLDADHEIRKAYTATAITDYFKRHTLKQEVDEKRNNETIKKIIDVELFYAITGQYLGVKGLLNIEKTDHKALAQDKEKVHQLKSFLDSIMELNHFVKPLVLSDDSISDKDDAFYSQFAPLYEQLNKFIPLYNMVRNYLTQKPYSTEKIKLNFERSTLLDGWDVNKEPDNTSVILRKDGLYYLAVMDKANNKVFQKAPKTDKPEASYEKMNYKLLPGANKMLPKVFFADSRIKYFKPSGEILENYKNDTHKKGETFNINDCHALIDFFKASLDKHEDWKHFNFKFSPTDSYKDLSGFYREVEHQGYKITFEKIPSAYIDNSVEDGKIYLFQIYNKDFSQFSKGKSNMHTMYWKALFDNKNLADVVYKLNGQAEVFFRKSSIEEKNKKVHKAHEPLKSKNPLTPNNKNTFEYDLIKDRRYTVDKFLFHVPITMNFKATGSEVINAQTNEFLENNPDVKIIGLDRGERHLIYLTLIDQQGNIIIQESLNTISNKERNIETAYHTLLHEKEKERDAARKSWNTIESIKELKEGYLSQVVHKIAEMMVKYNAIVVMEDLNFGFKRGRFKVEKQVYQKLEKMLIDKLNYLVFKNAEPTQTGGLFNALQLTNKFESFQKMGKQSGFLYYVPAAYTSKIDPTTGFIDFLKPKYENVEKAKDFFSKFDSIKYNTEKDYFEFAFDYKNFTAKVEGLKTDWFVCTHGDTRYRYNPQTKASEAVNVTQEMKTLFEKHNINYKDGKDLKNDVIQKEGKEIFSTLLHLMAMTLSLRHTKSGTEIDFILSPVANEKGEFYDSRTANKTLPQNADANGAYHIALKGLWCLQQINKADDMKKINLSISNKEWLEFVQNKK

SEQ ID NO: 499 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNRNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDSPQLLDGWDKNKERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFQFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 500 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNQNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDSPQLLRGWDKNKERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFQFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 501 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNQNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDSPQLLDGWDKNRERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFQFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 502 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNRNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDSPQLLRGWDKNKERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFQFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 503 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNRNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDSPQLLDGWDKNRERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFQFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 504 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNQNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDSPQLLRGWDKNRERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFQFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 505 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNRNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDSPQLLRGWDKNRERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFQFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 506 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNRNRENMYSDEDKSTAIGYRLIHDNLPKFIDNIKAFHQIAEEEGLSESLQSVYAEVGPCSGVEALADVFSLEYFNNVLTQKGITCYNGIVGELNKAVALYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDSPQLLDGWDKNRERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFQFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 507 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNQNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDRPQLLDGWDKNKERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFQFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 508 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNQNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDSPQLLDGWDKNKERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFLFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 509 - protein, 1224 aa, synthetic construct
MNFNEFTRLYPVSKTLRFELRPVGKTKENIEKNGFLIRDQIRAKDYIRIKAIIDEYHKAYIDEVLSRCVLQYDNEGKHNSLTEYVELVQRAGLDGRNKDTLKKVQTNLRKQIVSSFKQDQRHKYLFKKELIKDYLYDFVKTEEDRRLVDSFKSFTTYFTGFNQNRENMYSDEDKSTAIGYRLIHDNLPKFIDNIKAFHQIAEEEGLSESLQSVYAEVGPCSGVEALADVFSLEYFNNVLTQKGITCYNGIVGELNKAVNLYNQQHRDARLPKLKMLYKQILSDREPQSWLPEQFDNDDEVLRSIGEYHESMRAYLSNLKILLESIADYDLSGIFVRNDEQMTEISKRISGDWSTIQRAVVSDPKFKSFRKQKRSEDVETYEAELRKLYAKQGSFSIAYIDSVSGLAIESYFSNLGAVDTESRQEENLFAKIENAYAGVEKLLKEPYPHGKKLIGAKDGVALLKDLLDAWKELQRFVKPLLGVGDEADKDMRFYGELLPISDRLDKLTPLYNMVRNYVTRKPYSINKIKVNFDRPQLLDGWDKNKERDCLSVILRRGDNYYLAIIDKNHNRIFDGERLPCDGECYEKMVYKLLPGANKMLPKVFFSKSRIDEFAPSEDVLRIYNDETFKKGENFNLKDCHRLIDFYKDSIEKHEDWRSFDFIFSETESYEDISGFYREVEEQGYKLSFTPVSAAYIDSHVEESKLYLFQIYNKDFSEHSKGTPNMHTLYWKMLFDERNFADVVYQLNGGAELFYRERSIERTKPTHAANVPIKKKNRLNKKKESTFAYDLTKDKRYTVDKFLFHVPITLNFKSEGRDDINSKVRDYLHSADDVHVIGIDRGERNLLYLTVVDKHGRICEQLSLNEICNSYGGNDYKTDYHALLDKREHDRLRERQSWQTIEGIKELKEGYLSQVIHKIAELMVKYRAIVVLEDLNRGFMRGRQKVEKSVYQKFEKMLIDKLNYLVDKKADPELPGGLLKAYQLTSKFSSFAKQGKQSGFLFYVPAWNTSKIDPVTGFVNLLDLRYESKDKAKEWLNKFDTIRYNADRDMFEFSFDYDRFTSKAEGTRTVWTVCTHGTRIETFRNPEKNSEWDYREVDLTAEMKRLFEEYGIDITGNLKNAIAEQGDKAFFEQLLSLLRLTLQMRNSNSKESVDYIISPVADADGRFFDSRDADDSLPKDADANGAYNIARKGLMIIEQIKCADDVATVRFDLSNKNWLRYAQHSH

SEQ ID NO: 510 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHRNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLGGWDVNKEPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 511 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHKNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLRGWDVNKEPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 512 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHKNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLGGWDVNREPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 513 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHRNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLRGWDVNKEPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 514 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHRNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLGGWDVNREPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 515 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHKNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLRGWDVNREPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 516 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHRNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLRGWDVNREPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 517 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHRNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVALYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLGGWDVNREPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 518 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHKNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDRAQLLGGWDVNKEPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFQFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 519 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHKNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDNAQLLGGWDVNKEPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFLFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 520 - protein, 1242 aa, synthetic construct
MRNLTNLYPVSKTLRFELQPIGKTKENIEKNGILQRDEKRAEDYQKVKNLIDEYHKQFIKDRLWTFELPLEILEEYKELYETPKRDEAAFTEVKDNLRALIASQLKAKGSIYDRIFKKELIREDLIEFLDNEEDKEIVRQFADFTTYFSGFHKNRENMYSAEEKSTAIAYRLIHQNLPKFMDNMKAFALIAKSPVAEHFPDLYSAWEECLNVASIEEMFRLDYFSQTLTQTGIEVYNYIIGKKILEDGTEIKGINEYVNLYNQQQKDKKERLPLLVPLYKQILSDREKLSWLAEEFDSDEKMLNAINELYAHLHDLLMGEENESLHSILLQLKEYDLSQINIANDLSLTAISQQMFGRYDVFTNGMKDILRTITPHKKKETEEDFEERISKILKIQKSISIAELNKLPQPISEDGGKPKLVEDYFMSLGAVDDGVTQKANLFAQIENAHTDALSVLQLTGTGDTLSQNKTAVAKIKTLLDAFKDLQHFIKPLLGSGEENEKDELFYGSFQLFWDELDAVTPLYNKVRNWLTRKPYSTEKIKLNFDRAQLLGGWDVNKEPDCTGILLRKDGLYYLGIMNKKSNRIFDASVTPSDGDCYEKIDYKLLPGANKMLPKVFFSKSRIDEFAPSDAIINSYKRETHKKGANFSLRDCHRLIDFFKQSISKHEDWSKFGFHFSDTSSYEDISGFYREVEQQGYMLSSHPVSSAYIHQMVDEGKLFLFRIWNKDFSEYSKGTPNLHTLYWKMLFDERNLADVVYKLNGQAEVFYRKASIKPENRIIHPANQDIKNKNALNEKATSRFEYDIVKDRRYTVDKFLFHVPLTINFKATGQANVNPVVQEAIRKGEFTHIIGIDRGERHLLYLSLIDLKGRIVKQMTLNEIVNEYNGHSHTTDYHGLLADREGQRTTARRSWDTIENIKELKEGYLSQVIHVITKMMVEYKAIVVLEDLNMGFMRGRQKIERQVYEKFEKMLIEKLNCYIDKQADPTDVGGLLHALQLTNKFESFKKLGKQSGCLFYIPAWNTSKIDPVTGFVNLFDTRYETREKSRLFFSRFDRIAYNQDKDWFEFSFDYDNFTTRAEGCRTHWTLCTQGTRIRNFRNPQKNNQWDDEEVNLTALFKQLFDLYDIDIHGNLMEAIQRQTEAKFYQELMHLMKLTLQMRNSRINSEVDYLLSPVADEKGRFFDSRSGDCVLPDNADANGAYNIARKGLMLIQTIRETPDGEKPSLTITNREWLRFAQEKPYLVD

SEQ ID NO: 521 - protein, 1256 aa, synthetic construct
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNRNRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYINLFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFENSTLLNGWDENKEEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFQFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 522 - protein, 1256 aa, synthetic construct
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNENRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYINLFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFENSTLLRGWDENKEEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFQFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 523 - protein, 1256 aa, synthetic construct
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNENRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYINLFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFENSTLLNGWDENREEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFQFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 524 - protein, 1256 aa, synthetic construct
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNRNRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYINLFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFENSTLLRGWDENKEEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFQFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 525 - protein, 1256 aa, synthetic construct
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNRNRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYINLFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFENSTLLNGWDENREEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFQFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 526 - protein, 1256 aa, synthetic construct
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNENRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYINLFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFENSTLLRGWDENREEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFQFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 527 - protein, 1256 aa, synthetic construct
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNRNRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYINLFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFENSTLLRGWDENREEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFQFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 528 - protein, 1256 aa, synthetic construct
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNRNRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYIALFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFENSTLLNGWDENREEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFQFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 529 - protein, 1256 aa, synthetic construct
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNENRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYINLFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFERSTLLNGWDENKEEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFQFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 530 - protein, 1256 aa, synthetic construct
MLDQFTNLYSLSKTIKFELIPQGETLKWIEKKQLITIDKNRADEYKYLKKIIDKYHIQFINNALDGFRLTNLESYFELYKIQDKNDEQKKEIQEIQNKLRKQIADRFSKHPKLEIQKKYKNLFGKELINIDLKEFVETEIDKSIVDNFEKFTTYFTGFNENRKNMYTAEDKSTAISYRLIHQNLPKFIDNLKIFEKLKESEINSELVSIQNEIGNFFKINNINEVFQLDYFNEVLSQTGIDIYNQVIGGYTTNDGKTKIKGLNEYINLFNQNVKDKKNKIGKFKLLFKQILSDRNTASFILEEFKNDHDVLQSIDSMYQELNTYVFDENNSEIISLQEIINRLSEYDLNKIFIRNDISITDISQKLYGSWTLIGQALANDYDLKYKGKLIKGTERYETEQTNYIKKQDSFSIQYLNDCLKALPNNEQTTNLTEYFILLGENKKENIPNLIEQIKFQYKNLEEQIKTYSKDNNLTQDQTLVEKIKLFLDTIKALQWFVKPLLGKGIEPEKDIKFYGDLDKIWSTIDQITPLYNKVRNYVTKKPYNTEKIKLNFENSTLLNGWDENKEEANSAILFKKDENFYLGIMDKNSNKIFRKIPKPETNQLITKITYKLLPSASQNLPRIFFAKKNINTFAPSARVLNIRNHASHTKNGTPQDGCEKHEFNLDDCHAMIDFFKESIDKHKEWSKFGFKFTNTRDYKSIDEFYREVESQGYSITYKNIDNEYINELVSQGKLYYFQIYNKDFSSSSKGNPNMHTIYWKMLFDENNLRNIVYKLNGQAEIFFRKSSIKPENTIIHKEKYPISNKNTENQKKESQFEYDIIKDRRYTIDKFLFHVPITMNFKADGKENINERVNIMIKKSNDLHVIGIDRGERHLLYLTVLDTTGKLIEQFSLNDIVNEFNGKVYKTNYKYLLETKEGDRAKARLNWKTIENIKELKEGYLSQVIHKICELIKKYNAIVVLEDLNFGFVRGRQKVEKQVYQKFEKMLIDKLNYYVDKNLKPNDTGGCLNALQLTSKFISFQKMGKQSGWLFYVPAWNTSKIDPTTGFVNLFNTNYENTEKAKEFINNFNNIKYNNKEEYFEFEFDYSLFSAKAEGTINKWTICSYGDRVLTFRNELKNNTWDNKIIKLTPEWQALCNKFKIDFKSGNLKSDFLMQTSSQFYKEFLQLFKLTLQMRNSITNSDVDYLISPVKNLSGKFYDSRMANEYEPKDADANGAYNIGRKGLWVIEQIKKAADLRKLNLAISNKEWLNFAQRNR

SEQ ID NO: 531 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYRNRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNKATLLNGWDISKERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFQFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 532 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYENRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNKATLLRGWDISKERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFQFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 533 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYENRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNKATLLNGWDISRERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFQFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 534 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYRNRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNKATLLRGWDISKERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFQFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 535 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYRNRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNKATLLNGWDISRERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFQFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 536 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYENRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNKATLLRGWDISRERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFQFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 537 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYRNRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNKATLLRGWDISRERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFQFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 538 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYRNRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELIALYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNKATLLNGWDISRERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFQFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 539 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYENRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNRATLLNGWDISKERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFQFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 540 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYENRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNKATLLNGWDISKERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFLFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 541 - protein, 1235 aa, synthetic construct
MLLADSFMDRYPVSKTLRFELKPIGKTLEHIESDGLLDVDFKRAEDYKKVKKIIDQYHKVLIDEALAGIKLDGLNDYYDLYCKSVKDEYQKDQFEKIQSDLRKQIVATLKKHPNYAALFKKELIEDILPEFVNDIEDIKVIKEFKGFSTYFQGFYENRKNMYSDEAKSTSIAYRIIHQNLPKYIDNINVFRKVIEVDDLMDCNQLDERFEGKYSVKSVEDYFTLDGFNSVITQKGITEYNTVIGGFFNDKEEKVQGINELINLYNQQNKTKIPKMKPLFKQILSDRESASFTIDQFTSDDEVLLAIKAYKDELEQKIFDSKEDISPKKLFESIDRYSIDKIYVNNDVSLTAISQQLCGDWSVIKEAISDDYDKKAVLAKPKTKIVSEKYREKKQKELNKVAYYSLAELNFLFKTKGYDVSICDYYALRISEIFKKIDNSCDKLTDILDKEYKGNLKNDEQTVEYIKTYLDSLKELQSLIKQLVIKSNVGDIDFAFYAEIDRISEELFKLNTLYNKVRNYVTQKPYSTEKIKLNFNRATLLNGWDISKERDNLGVLLSKNEIHYLGIISTSDTSAMKNLPKAKTNDVYKKMNYKLLPSPSKMLPKVFLSKKGINKYQPSAELLSNYAKETHKKGENFSLEDCHSLIKFFKESIKKNDDWKVFGFEFSDTETYNDISGFYREVEQQGYSITYTDVDSDYINQLVDEGKLYLFQIHNKDFSPYAKGVPNLHTLYWKALFAEENLDNIVYKLNGEAEIFYRKHSIDSEDIVKHPANQPIRNKNLDATKKESIFEYDLIKDRRYTVDKFLFHVPITMNFCRSSSTNINADMNMHLKYADPEDINVIGIDRGERNLLYLVVVDCNGNIKEQISLNEIVSYNKRGESFSTDYHKLLDKKEKDRKAAREDWKTIGNIKEIKEGYLSQVIHVIVELMIKYNAVVVLEDLNFGFKRGRQKVEKQVYQKFEKMLIDKLNYYVDKRKAATENGGLYHAYQLTNKFDSFEKMGKQSGALFYIPAWMTSKIDPTTGFTNLFYVKYKSVEESKKFFDSFDNIIFNETEGYFEFYTDYEKFTNKVGDSRKDWTICSYGERIKRFRNPEKNNEWDARKVNLTNEFINIFNAFGIDYKSNNLKLMILDINESEFYKKMISLFSLVVQMRNSNSVTGEDYMISPVKNKAGHFFVSGENDSDPRDADANGAYHIARKGWWIIEKLQQTDDDKLLKLPVINQVEWLKYVQENPLNG

SEQ ID NO: 542 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHRNRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLGGWDLNKEPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 543 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHENRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLRGWDLNKEPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 544 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHENRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLGGWDLNREPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 545 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHRNRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLRGWDLNKEPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 546 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHRNRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLGGWDLNREPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 547 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHENRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLRGWDLNREPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 548 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHRNRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLRGWDLNREPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 549 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHRNRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVALYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLGGWDLNREPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 550 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHENRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDRAQLLGGWDLNKEPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFQFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 551 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHENRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDNAQLLGGWDLNKEPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFLFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 552 - protein, 1242 aa, synthetic construct
MERFDELTGLYSLSKTLQFELKPIGKTLEQIERKGIIAQDEKRAEEYEIAKCIIDEYHKAFISMCLKGLRLNLSSTGSLDSLEEYVEQASKLRRSESEEKNFDTIKQNLRRQIVNSFKSRGGSFTDLFKKELITQHLPEFVSEKNKKQIVENFSKFTTYFTGFHENRKNLYSEEEKSTAIAYRLIHENLPMFIDNIKTFAKIADSDVANYFVEIETTFSEYLDGSHITDMFKLEYFTETLTQEQISLYNNVIGGVSNEDGTKKKGLNEYVNLYNQQNKTRLPLLKPLYKMLLSDKVSLSWLPDDFVSDEEMIYAINEMQLSLKDLLYSDGENSLKYLLTHIGDYDTEHIYISNDLGLTDISQQIFGQYDVYTSGIKTELCNQIKQSAKEKREPELYKERINKLFKSAKSFSINYLNSFAEGDKTIQAYYARLGAHDLEGEQSTNLFTQIEMASIAASDILAGKHTNINQSEEDTKLIKDLLDTYKALQHFIKPLLGNGDEADKDNEFDARLRNAWDALSVVTPLYNKVRNWLTRKPYSTEKIKLNFDRAQLLGGWDLNKEPDCTSVLLRKDDMFYLAIMDKKYNHAFDIDELPCEGECYEKVDYKLLPGANKMLPKVFFSKSRISEFAPSLAIQKSYNEGTHKKGSNFSISDCHRLIDFFKQSIAKHEDWSKFPFSFSDTKRYEDISGFYREVEQQGYMLSYRNVSVSFINQLVDEGKLYLFQIWNKDFSKYSKGTPNMHTLYWKMLFDEVNLADTVYKLNGQAEVFYRKSSLKLENTTIHKANQTIKNKNVQNEKKTSTFDYDIVKNRRYTVDKFLFHVPITLNFKATGGDNINANVQDIIRNNGIEHIIGIDRGERHLLYLSLIDLKGNIVKQMTLNDIINEYKGNIYKTNYKDLLVTREGDRTEARRNWHKIENIKDLKEGYLSQVVHIIARMMAEYKAIVVLEDLNMGFMRGRQKIERNVYEQFERMLIDKLNYYVDKQKKATENGGLLHALQLANKFESFKKLGKQSGCLFYIPAWNTSKIDPVTGFVNLFEIHYENVDKARCFFSKFDIIQYNEERDWFEFAFDYNDFGTKAEGTKSKWTLCTYGTRIKTFRNPNKLNQWDNEEVVLTEEFKKIFNEAGIDINGNIKDAICQLKEKKHLESLMHLMKLLLQMRNSVSNSEIDYLLSPVADENGEFYDSRTCAPTLPKDADANGAYNIARKGLWVIEQIKQTADKPRLAMTNKEWLKFAQDKPYLNE

SEQ ID NO: 553 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHRNRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKNSSLMKGWDLNKEEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFQFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 554 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHENRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKNSSLMRGWDLNKEEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFQFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 555 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHENRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKNSSLMKGWDLNREEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFQFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 556 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHRNRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKNSSLMRGWDLNKEEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFQFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 557 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHRNRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKNSSLMKGWDLNREEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFQFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 558 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHENRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKNSSLMRGWDLNREEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFQFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 559 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHRNRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKNSSLMRGWDLNREEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFQFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 560 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHRNRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYIALYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKNSSLMKGWDLNREEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFQFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 561 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHENRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKRSSLMKGWDLNKEEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFQFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 562 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHENRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKNSSLMKGWDLNKEEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFLFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 563 - protein, 1294 aa, synthetic construct
MKTFKKFEDFTKVYPLSKTLRFELIPVGKTLNSIIKSGILEEDQHRANSYITVKKILDEYHKAFIEDVLTNFKLTCNSEGKKNSLEEFYNIYTCKSKDDIQKKIFDEVCKNLRKQIVDRFTTDERFKRIDKKELIRTDLISFAKDEEKKLIEEFKDFTTYFIGFHENRKNMYSSENKSTAIAYRLIHENLPRFVDNISVFEKLKESPIAEQFGTLYSEFKEYLNVTKICEIFKLDYYSTLLTQKQIDIYNAIIGGKTIEESNIKIKGLNEYINLYNQQQKNKTMRLPKLKPLYKQILSDRNAISWLPEQFESDEKVLEAIQKAYQELEEQVLNSQKEEEHSLKHLLQSLENYNLDKVYIRNNQQMTDISQKIFGDYGLISKALMDELKRTIPKKTKKETDENYKERLDKVFKSQGSISIAQINQSIQAYDNDNSNNIQDYFATMGAVNTETLHKENLFIQIQKAYDEAKDILNTPYPTDKKLVQDKESVDKIKNLLDTIKALQHFVKPLLGDGTEAEKDDKFYGEFTALWMELDKITPLYNKVRNYITQKPYSTEKIKLNFKRSSLMKGWDLNKEEDNTTIILRKDGLYYLAIMDKKHNKVFNVKNTPNTGECFEKLEYKYFKDLTTMVPKCTTQLNEVKTHFSTHTSPYIIKKDVFSSEFTITKDEYDLNNVLYNGNKKFQIGYLRQTRDEKGYKEALSNWIRFCLRFLLHYKSTLVYDISSFCSESKIKSYTSVDEFYKEINLYLYNISFRNVSVDYINDLVNEEKIYLFQIYNKDFSPYSKGTPNLHTLYWKMLFDERNISNVVYKLNGEAEVFFRKSSIDCVRPTHAANQSISNKNELNTKKESTFAYDLIKNKRYTVNKFLFHVPITMNFKSIGNNNINQLVNEYIKQAEDLHIIGIDRGERHLLYLSVIDIKGNIKEQYSLNEIINEYNGNRYVTNYHNILTKREDDRVKSRQSWQTIENIKELKEGYLSQVIHKISELMIKYNAIIVLEDLNQGFKRGRQKVESSVYQQFEKKLIDKLNYLADKKRQAEEPGGILNAYQLTNKFESFKRIGKQNGFIYYVPAWNTSKIDPVTGFVNLFDTRYETINKAKEFFNKFDVIQYNEEMDWFEFICDYSNFSPLKYEGSRTQWRICSVGNRIETTRDKTKNSNWSSREIVLNDEFKILFKNKGISISSNIKEEISKQNDAKFFKELLHLFKLTLQIRNSKIGSDIDYLQSPVADINGTFYNSEICDNSLPQNADANGAYNIARKGLWIVRQIKTSDNLKDIKLAISNKEWLEFAQSKPYLNV

SEQ ID NO: 564 - protein, 1245 aa, synthetic construct
MSLYDSFTGVYPVQKTLRFELIPVGETQEHIEKKGYLVTDEHRADSYKKVKKIIDRYHKDFIESVLGQIQLDGLEEYAKLYYEKQRNDQQEKQFDTIKKGLRKQISDAFKSFDQFKKMFGKEMIEDLLIKYTEDNPDDQKSVLEFESFSTYFQGFYRNRKNMYSGEGKSTEVAYRIVDQNLPKYLDNIIIYEKAYQSGLGDKIEKTLKEVNKHYELESIEELFELKGFNSVLSQKGIDMYNCIIGGFSESDRVKVQGINETINLYNQQVNSKDNKKIPKCKSLFKQILSDRENISFIQDQFESDEEVVAAIYDFYDEMQTSLFENSDSLNIDELFSDIGNYNLEGVYIKNCQALTDISQHLYSDWSIINHALESNYDNNQSSKNKNTEKYIEKRKKELKKNKYYAIAFINQILSDYTKEDVAVEKYYSDLFVGEENYLKKITDQKKKLDEVVKSWKESGKSLNKNDEIIEAIKELLDLFKDLQRIIQPLINNDVSSKDFMFYNELERMWNNLDVLTSLYNKVRNYITRKPYSIEKYKLNFNRPTLLAGWDKSKERDCLGILLRKNDLYYLCIMDKNNSKVFMDVPRGNGDSCYEKMEYKQVKPLTDFAHVFFAKKNIKKYNPSEEILKIKKDESYIKNNDNFSLDNCHKLIDFYKECIKINEEYEIFNFKFSDTSSYNDISEFYKEADKYKYAIQFEYVDENYINQLVAEGKIYLFQIYNKDFSVYSKGNPNLHTLYWKMLFYPENLKNIVYKLNGQAEIFYRKSSINKEDIIRHPANIPINNKNELNTKKTSVFDYELIKDKRFTIDKYQFHVPITMNFGALGDNHFNRTVNTVIKNTDDVNVIGIDRGERNLLYLVVINSKGEIIKQKSLNEIINVGKNNIYHKTDYHKLLDYREKENKAARNNWKTINTIKELKEGYLSQVIHVITEWMVKYNAIVVLEDLNFGFKRGRQKFEKQVYQKFEKMLIDKLNYYVDKNADVQSPSGLLKALQLTNKFDSFSNMGKQSGFLYYVPAYLTSKIDPTTGFANLFNGSDLRYSSVETSKEFFNKFKSIIYNPNGINGKDYFEFTFDYLDFTYKAEGTQSVWTVCTFDKRIHHYRNSSKNNEWDTEEIDLTQSVKDLFNKFDVNMEEGNLKEKIINISDKSFYKDLLWLFSLTLQMRNSDADKNIDRLISPVLNEKGFFYDSDLKSDMLPYDADANGAYNIAKKGLWIINQIKSMDDDKVDKLKTISNKEWLQFAQENKL

SEQ ID NO: 565 - protein, 1245 aa, synthetic construct
MSLYDSFTGVYPVQKTLRFELIPVGETQEHIEKKGYLVTDEHRADSYKKVKKIIDRYHKDFIESVLGQIQLDGLEEYAKLYYEKQRNDQQEKQFDTIKKGLRKQISDAFKSFDQFKKMFGKEMIEDLLIKYTEDNPDDQKSVLEFESFSTYFQGFYENRKNMYSGEGKSTEVAYRIVDQNLPKYLDNIIIYEKAYQSGLGDKIEKTLKEVNKHYELESIEELFELKGFNSVLSQKGIDMYNCIIGGFSESDRVKVQGINETINLYNQQVNSKDNKKIPKCKSLFKQILSDRENISFIQDQFESDEEVVAAIYDFYDEMQTSLFENSDSLNIDELFSDIGNYNLEGVYIKNCQALTDISQHLYSDWSIINHALESNYDNNQSSKNKNTEKYIEKRKKELKKNKYYAIAFINQILSDYTKEDVAVEKYYSDLFVGEENYLKKITDQKKKLDEVVKSWKESGKSLNKNDEIIEAIKELLDLFKDLQRIIQPLINNDVSSKDFMFYNELERMWNNLDVLTSLYNKVRNYITRKPYSIEKYKLNFNRPTLLRGWDKSKERDCLGILLRKNDLYYLCIMDKNNSKVFMDVPRGNGDSCYEKMEYKQVKPLTDFAHVFFAKKNIKKYNPSEEILKIKKDESYIKNNDNFSLDNCHKLIDFYKECIKINEEYEIFNFKFSDTSSYNDISEFYKEADKYKYAIQFEYVDENYINQLVAEGKIYLFQIYNKDFSVYSKGNPNLHTLYWKMLFYPENLKNIVYKLNGQAEIFYRKSSINKEDIIRHPANIPINNKNELNTKKTSVFDYELIKDKRFTIDKYQFHVPITMNFGALGDNHFNRTVNTVIKNTDDVNVIGIDRGERNLLYLVVINSKGEIIKQKSLNEIINVGKNNIYHKTDYHKLLDYREKENKAARNNWKTINTIKELKEGYLSQVIHVITEWMVKYNAIVVLEDLNFGFKRGRQKFEKQVYQKFEKMLIDKLNYYVDKNADVQSPSGLLKALQLTNKFDSFSNMGKQSGFLYYVPAYLTSKIDPTTGFANLFNGSDLRYSSVETSKEFFNKFKSIIYNPNGINGKDYFEFTFDYLDFTYKAEGTQSVWTVCTFDKRIHHYRNSSKNNEWDTEEIDLTQSVKDLFNKFDVNMEEGNLKEKIINISDKSFYKDLLWLFSLTLQMRNSDADKNIDRLISPVLNEKGFFYDSDLKSDMLPYDADANGAYNIAKKGLWIINQIKSMDDDKVDKLKTISNKEWLQFAQENKL

SEQ ID NO: 566 - protein, 1245 aa, synthetic construct
MSLYDSFTGVYPVQKTLRFELIPVGETQEHIEKKGYLVTDEHRADSYKKVKKIIDRYHKDFIESVLGQIQLDGLEEYAKLYYEKQRNDQQEKQFDTIKKGLRKQISDAFKSFDQFKKMFGKEMIEDLLIKYTEDNPDDQKSVLEFESFSTYFQGFYENRKNMYSGEGKSTEVAYRIVDQNLPKYLDNIIIYEKAYQSGLGDKIEKTLKEVNKHYELESIEELFELKGFNSVLSQKGIDMYNCIIGGFSESDRVKVQGINETINLYNQQVNSKDNKKIPKCKSLFKQILSDRENISFIQDQFESDEEVVAAIYDFYDEMQTSLFENSDSLNIDELFSDIGNYNLEGVYIKNCQALTDISQHLYSDWSIINHALESNYDNNQSSKNKNTEKYIEKRKKELKKNKYYAIAFINQILSDYTKEDVAVEKYYSDLFVGEENYLKKITDQKKKLDEVVKSWKESGKSLNKNDEIIEAIKELLDLFKDLQRIIQPLINNDVSSKDFMFYNELERMWNNLDVLTSLYNKVRNYITRKPYSIEKYKLNFNRPTLLAGWDKSRERDCLGILLRKNDLYYLCIMDKNNSKVFMDVPRGNGDSCYEKMEYKQVKPLTDFAHVFFAKKNIKKYNPSEEILKIKKDESYIKNNDNFSLDNCHKLIDFYKECIKINEEYEIFNFKFSDTSSYNDISEFYKEADKYKYAIQFEYVDENYINQLVAEGKIYLFQIYNKDFSVYSKGNPNLHTLYWKMLFYPENLKNIVYKLNGQAEIFYRKSSINKEDIIRHPANIPINNKNELNTKKTSVFDYELIKDKRFTIDKYQFHVPITMNFGALGDNHFNRTVNTVIKNTDDVNVIGIDRGERNLLYLVVINSKGEIIKQKSLNEIINVGKNNIYHKTDYHKLLDYREKENKAARNNWKTINTIKELKEGYLSQVIHVITEWMVKYNAIVVLEDLNFGFKRGRQKFEKQVYQKFEKMLIDKLNYYVDKNADVQSPSGLLKALQLTNKFDSFSNMGKQSGFLYYVPAYLTSKIDPTTGFANLFNGSDLRYSSVETSKEFFNKFKSIIYNPNGINGKDYFEFTFDYLDFTYKAEGTQSVWTVCTFDKRIHHYRNSSKNNEWDTEEIDLTQSVKDLFNKFDVNMEEGNLKEKIINISDKSFYKDLLWLFSLTLQMRNSDADKNIDRLISPVLNEKGFFYDSDLKSDMLPYDADANGAYNIAKKGLWIINQIKSMDDDKVDKLKTISNKEWLQFAQENKL

SEQ ID NO: 567 - protein, 1245 aa, synthetic construct
MSLYDSFTGVYPVQKTLRFELIPVGETQEHIEKKGYLVTDEHRADSYKKVKKIIDRYHKDFIESVLGQIQLDGLEEYAKLYYEKQRNDQQEKQFDTIKKGLRKQISDAFKSFDQFKKMFGKEMIEDLLIKYTEDNPDDQKSVLEFESFSTYFQGFYRNRKNMYSGEGKSTEVAYRIVDQNLPKYLDNIIIYEKAYQSGLGDKIEKTLKEVNKHYELESIEELFELKGFNSVLSQKGIDMYNCIIGGFSESDRVKVQGINETINLYNQQVNSKDNKKIPKCKSLFKQILSDRENISFIQDQFESDEEVVAAIYDFYDEMQTSLFENSDSLNIDELFSDIGNYNLEGVYIKNCQALTDISQHLYSDWSIINHALESNYDNNQSSKNKNTEKYIEKRKKELKKNKYYAIAFINQILSDYTKEDVAVEKYYSDLFVGEENYLKKITDQKKKLDEVVKSWKESGKSLNKNDEIIEAIKELLDLFKDLQRIIQPLINNDVSSKDFMFYNELERMWNNLDVLTSLYNKVRNYITRKPYSIEKYKLNFNRPTLLRGWDKSKERDCLGILLRKNDLYYLCIMDKNNSKVFMDVPRGNGDSCYEKMEYKQVKPLTDFAHVFFAKKNIKKYNPSEEILKIKKDESYIKNNDNFSLDNCHKLIDFYKECIKINEEYEIFNFKFSDTSSYNDISEFYKEADKYKYAIQFEYVDENYINQLVAEGKIYLFQIYNKDFSVYSKGNPNLHTLYWKMLFYPENLKNIVYKLNGQAEIFYRKSSINKEDIIRHPANIPINNKNELNTKKTSVFDYELIKDKRFTIDKYQFHVPITMNFGALGDNHFNRTVNTVIKNTDDVNVIGIDRGERNLLYLVVINSKGEIIKQKSLNEIINVGKNNIYHKTDYHKLLDYREKENKAARNNWKTINTIKELKEGYLSQVIHVITEWMVKYNAIVVLEDLNFGFKRGRQKFEKQVYQKFEKMLIDKLNYYVDKNADVQSPSGLLKALQLTNKFDSFSNMGKQSGFLYYVPAYLTSKIDPTTGFANLFNGSDLRYSSVETSKEFFNKFKSIIYNPNGINGKDYFEFTFDYLDFTYKAEGTQSVWTVCTFDKRIHHYRNSSKNNEWDTEEIDLTQSVKDLFNKFDVNMEEGNLKEKIINISDKSFYKDLLWLFSLTLQMRNSDADKNIDRLISPVLNEKGFFYDSDLKSDMLPYDADANGAYNIAKKGLWIINQIKSMDDDKVDKLKTISNKEWLQFAQENKL

SEQ ID NO: 568 - protein, 1245 aa, synthetic construct
MSLYDSFTGVYPVQKTLRFELIPVGETQEHIEKKGYLVTDEHRADSYKKVKKIIDRYHKDFIESVLGQIQLDGLEEYAKLYYEKQRNDQQEKQFDTIKKGLRKQISDAFKSFDQFKKMFGKEMIEDLLIKYTEDNPDDQKSVLEFESFSTYFQGFYRNRKNMYSGEGKSTEVAYRIVDQNLPKYLDNIIIYEKAYQSGLGDKIEKTLKEVNKHYELESIEELFELKGFNSVLSQKGIDMYNCIIGGFSESDRVKVQGINETINLYNQQVNSKDNKKIPKCKSLFKQILSDRENISFIQDQFESDEEVVAAIYDFYDEMQTSLFENSDSLNIDELFSDIGNYNLEGVYIKNCQALTDISQHLYSDWSIINHALESNYDNNQSSKNKNTEKYIEKRKKELKKNKYYAIAFINQILSDYTKEDVAVEKYYSDLFVGEENYLKKITDQKKKLDEVVKSWKESGKSLNKNDEIIEAIKELLDLFKDLQRIIQPLINNDVSSKDFMFYNELERMWNNLDVLTSLYNKVRNYITRKPYSIEKYKLNFNRPTLLAGWDKSRERDCLGILLRKNDLYYLCIMDKNNSKVFMDVPRGNGDSCYEKMEYKQVKPLTDFAHVFFAKKNIKKYNPSEEILKIKKDESYIKNNDNFSLDNCHKLIDFYKECIKINEEYEIFNFKFSDTSSYNDISEFYKEADKYKYAIQFEYVDENYINQLVAEGKIYLFQIYNKDFSVYSKGNPNLHTLYWKMLFYPENLKNIVYKLNGQAEIFYRKSSINKEDIIRHPANIPINNKNELNTKKTSVFDYELIKDKRFTIDKYQFHVPITMNFGALGDNHFNRTVNTVIKNTDDVNVIGIDRGERNLLYLVVINSKGEIIKQKSLNEIINVGKNNIYHKTDYHKLLDYREKENKAARNNWKTINTIKELKEGYLSQVIHVITEWMVKYNAIVVLEDLNFGFKRGRQKFEKQVYQKFEKMLIDKLNYYVDKNADVQSPSGLLKALQLTNKFDSFSNMGKQSGFLYYVPAYLTSKIDPTTGFANLFNGSDLRYSSVETSKEFFNKFKSIIYNPNGINGKDYFEFTFDYLDFTYKAEGTQSVWTVCTFDKRIHHYRNSSKNNEWDTEEIDLTQSVKDLFNKFDVNMEEGNLKEKIINISDKSFYKDLLWLFSLTLQMRNSDADKNIDRLISPVLNEKGFFYDSDLKSDMLPYDADANGAYNIAKKGLWIINQIKSMDDDKVDKLKTISNKEWLQFAQENKL

SEQ ID NO: 569 - protein, 1245 aa, synthetic construct
MSLYDSFTGVYPVQKTLRFELIPVGETQEHIEKKGYLVTDEHRADSYKKVKKIIDRYHKDFIESVLGQIQLDGLEEYAKLYYEKQRNDQQEKQFDTIKKGLRKQISDAFKSFDQFKKMFGKEMIEDLLIKYTEDNPDDQKSVLEFESFSTYFQGFYENRKNMYSGEGKSTEVAYRIVDQNLPKYLDNIIIYEKAYQSGLGDKIEKTLKEVNKHYELESIEELFELKGFNSVLSQKGIDMYNCIIGGFSESDRVKVQGINETINLYNQQVNSKDNKKIPKCKSLFKQILSDRENISFIQDQFESDEEVVAAIYDFYDEMQTSLFENSDSLNIDELFSDIGNYNLEGVYIKNCQALTDISQHLYSDWSIINHALESNYDNNQSSKNKNTEKYIEKRKKELKKNKYYAIAFINQILSDYTKEDVAVEKYYSDLFVGEENYLKKITDQKKKLDEVVKSWKESGKSLNKNDEIIEAIKELLDLFKDLQRIIQPLINNDVSSKDFMFYNELERMWNNLDVLTSLYNKVRNYITRKPYSIEKYKLNFNRPTLLRGWDKSRERDCLGILLRKNDLYYLCIMDKNNSKVFMDVPRGNGDSCYEKMEYKQVKPLTDFAHVFFAKKNIKKYNPSEEILKIKKDESYIKNNDNFSLDNCHKLIDFYKECIKINEEYEIFNFKFSDTSSYNDISEFYKEADKYKYAIQFEYVDENYINQLVAEGKIYLFQIYNKDFSVYSKGNPNLHTLYWKMLFYPENLKNIVYKLNGQAEIFYRKSSINKEDIIRHPANIPINNKNELNTKKTSVFDYELIKDKRFTIDKYQFHVPITMNFGALGDNHFNRTVNTVIKNTDDVNVIGIDRGERNLLYLVVINSKGEIIKQKSLNEIINVGKNNIYHKTDYHKLLDYREKENKAARNNWKTINTIKELKEGYLSQVIHVITEWMVKYNAIVVLEDLNFGFKRGRQKFEKQVYQKFEKMLIDKLNYYVDKNADVQSPSGLLKALQLTNKFDSFSNMGKQSGFLYYVPAYLTSKIDPTTGFANLFNGSDLRYSSVETSKEFFNKFKSIIYNPNGINGKDYFEFTFDYLDFTYKAEGTQSVWTVCTFDKRIHHYRNSSKNNEWDTEEIDLTQSVKDLFNKFDVNMEEGNLKEKIINISDKSFYKDLLWLFSLTLQMRNSDADKNIDRLISPVLNEKGFFYDSDLKSDMLPYDADANGAYNIAKKGLWIINQIKSMDDDKVDKLKTISNKEWLQFAQENKL

SEQ ID NO: 570 - protein, 1245 aa, synthetic construct
MSLYDSFTGVYPVQKTLRFELIPVGETQEHIEKKGYLVTDEHRADSYKKVKKIIDRYHKDFIESVLGQIQLDGLEEYAKLYYEKQRNDQQEKQFDTIKKGLRKQISDAFKSFDQFKKMFGKEMIEDLLIKYTEDNPDDQKSVLEFESFSTYFQGFYRNRKNMYSGEGKSTEVAYRIVDQNLPKYLDNIIIYEKAYQSGLGDKIEKTLKEVNKHYELESIEELFELKGFNSVLSQKGIDMYNCIIGGFSESDRVKVQGINETINLYNQQVNSKDNKKIPKCKSLFKQILSDRENISFIQDQFESDEEVVAAIYDFYDEMQTSLFENSDSLNIDELFSDIGNYNLEGVYIKNCQALTDISQHLYSDWSIINHALESNYDNNQSSKNKNTEKYIEKRKKELKKNKYYAIAFINQILSDYTKEDVAVEKYYSDLFVGEENYLKKITDQKKKLDEVVKSWKESGKSLNKNDEIIEAIKELLDLFKDLQRIIQPLINNDVSSKDFMFYNELERMWNNLDVLTSLYNKVRNYITRKPYSIEKYKLNFNRPTLLRGWDKSRERDCLGILLRKNDLYYLCIMDKNNSKVFMDVPRGNGDSCYEKMEYKQVKPLTDFAHVFFAKKNIKKYNPSEEILKIKKDESYIKNNDNFSLDNCHKLIDFYKECIKINEEYEIFNFKFSDTSSYNDISEFYKEADKYKYAIQFEYVDENYINQLVAEGKIYLFQIYNKDFSVYSKGNPNLHTLYWKMLFYPENLKNIVYKLNGQAEIFYRKSSINKEDIIRHPANIPINNKNELNTKKTSVFDYELIKDKRFTIDKYQFHVPITMNFGALGDNHFNRTVNTVIKNTDDVNVIGIDRGERNLLYLVVINSKGEIIKQKSLNEIINVGKNNIYHKTDYHKLLDYREKENKAARNNWKTINTIKELKEGYLSQVIHVITEWMVKYNAIVVLEDLNFGFKRGRQKFEKQVYQKFEKMLIDKLNYYVDKNADVQSPSGLLKALQLTNKFDSFSNMGKQSGFLYYVPAYLTSKIDPTTGFANLFNGSDLRYSSVETSKEFFNKFKSIIYNPNGINGKDYFEFTFDYLDFTYKAEGTQSVWTVCTFDKRIHHYRNSSKNNEWDTEEIDLTQSVKDLFNKFDVNMEEGNLKEKIINISDKSFYKDLLWLFSLTLQMRNSDADKNIDRLISPVLNEKGFFYDSDLKSDMLPYDADANGAYNIAKKGLWIINQIKSMDDDKVDKLKTISNKEWLQFAQENKL

SEQ ID NO: 571 - protein, 1245 aa, synthetic construct
MSLYDSFTGVYPVQKTLRFELIPVGETQEHIEKKGYLVTDEHRADSYKKVKKIIDRYHKDFIESVLGQIQLDGLEEYAKLYYEKQRNDQQEKQFDTIKKGLRKQISDAFKSFDQFKKMFGKEMIEDLLIKYTEDNPDDQKSVLEFESFSTYFQGFYRNRKNMYSGEGKSTEVAYRIVDQNLPKYLDNIIIYEKAYQSGLGDKIEKTLKEVNKHYELESIEELFELKGFNSVLSQKGIDMYNCIIGGFSESDRVKVQGINETIALYNQQVNSKDNKKIPKCKSLFKQILSDRENISFIQDQFESDEEVVAAIYDFYDEMQTSLFENSDSLNIDELFSDIGNYNLEGVYIKNCQALTDISQHLYSDWSIINHALESNYDNNQSSKNKNTEKYIEKRKKELKKNKYYAIAFINQILSDYTKEDVAVEKYYSDLFVGEENYLKKITDQKKKLDEVVKSWKESGKSLNKNDEIIEAIKELLDLFKDLQRIIQPLINNDVSSKDFMFYNELERMWNNLDVLTSLYNKVRNYITRKPYSIEKYKLNFNRPTLLAGWDKSRERDCLGILLRKNDLYYLCIMDKNNSKVFMDVPRGNGDSCYEKMEYKQVKPLTDFAHVFFAKKNIKKYNPSEEILKIKKDESYIKNNDNFSLDNCHKLIDFYKECIKINEEYEIFNFKFSDTSSYNDISEFYKEADKYKYAIQFEYVDENYINQLVAEGKIYLFQIYNKDFSVYSKGNPNLHTLYWKMLFYPENLKNIVYKLNGQAEIFYRKSSINKEDIIRHPANIPINNKNELNTKKTSVFDYELIKDKRFTIDKYQFHVPITMNFGALGDNHFNRTVNTVIKNTDDVNVIGIDRGERNLLYLVVINSKGEIIKQKSLNEIINVGKNNIYHKTDYHKLLDYREKENKAARNNWKTINTIKELKEGYLSQVIHVITEWMVKYNAIVVLEDLNFGFKRGRQKFEKQVYQKFEKMLIDKLNYYVDKNADVQSPSGLLKALQLTNKFDSFSNMGKQSGFLYYVPAYLTSKIDPTTGFANLFNGSDLRYSSVETSKEFFNKFKSIIYNPNGINGKDYFEFTFDYLDFTYKAEGTQSVWTVCTFDKRIHHYRNSSKNNEWDTEEIDLTQSVKDLFNKFDVNMEEGNLKEKIINISDKSFYKDLLWLFSLTLQMRNSDADKNIDRLISPVLNEKGFFYDSDLKSDMLPYDADANGAYNIAKKGLWIINQIKSMDDDKVDKLKTISNKEWLQFAQENKL

SEQ ID NO: 572 - protein, 1245 aa, synthetic construct
MSLYDSFTGVYPVQKTLRFELIPVGETQEHIEKKGYLVTDEHRADSYKKVKKIIDRYHKDFIESVLGQIQLDGLEEYAKLYYEKQRNDQQEKQFDTIKKGLRKQISDAFKSFDQFKKMFGKEMIEDLLIKYTEDNPDDQKSVLEFESFSTYFQGFYENRKNMYSGEGKSTEVAYRIVDQNLPKYLDNIIIYEKAYQSGLGDKIEKTLKEVNKHYELESIEELFELKGFNSVLSQKGIDMYNCIIGGFSESDRVKVQGINETINLYNQQVNSKDNKKIPKCKSLFKQILSDRENISFIQDQFESDEEVVAAIYDFYDEMQTSLFENSDSLNIDELFSDIGNYNLEGVYIKNCQALTDISQHLYSDWSIINHALESNYDNNQSSKNKNTEKYIEKRKKELKKNKYYAIAFINQILSDYTKEDVAVEKYYSDLFVGEENYLKKITDQKKKLDEVVKSWKESGKSLNKNDEIIEAIKELLDLFKDLQRIIQPLINNDVSSKDFMFYNELERMWNNLDVLTSLYNKVRNYITRKPYSIEKYKLNFNRPTLLAGWDKSKERDCLGILLRKNDLYYLCIMDKNNSKVFMDVPRGNGDSCYEKMEYKQVKPLTDFAHVFFAKKNIKKYNPSEEILKIKKDESYIKNNDNFSLDNCHKLIDFYKECIKINEEYEIFNFKFSDTSSYNDISEFYKEADKYKYAIQFEYVDENYINQLVAEGKIYLFQIYNKDFSVYSKGNPNLHTLYWKMLFYPENLKNIVYKLNGQAEIFYRKSSINKEDIIRHPANIPINNKNELNTKKTSVFDYELIKDKRFTIDKYLFHVPITMNFGALGDNHFNRTVNTVIKNTDDVNVIGIDRGERNLLYLVVINSKGEIIKQKSLNEIINVGKNNIYHKTDYHKLLDYREKENKAARNNWKTINTIKELKEGYLSQVIHVITEWMVKYNAIVVLEDLNFGFKRGRQKFEKQVYQKFEKMLIDKLNYYVDKNADVQSPSGLLKALQLTNKFDSFSNMGKQSGFLYYVPAYLTSKIDPTTGFANLFNGSDLRYSSVETSKEFFNKFKSIIYNPNGINGKDYFEFTFDYLDFTYKAEGTQSVWTVCTFDKRIHHYRNSSKNNEWDTEEIDLTQSVKDLFNKFDVNMEEGNLKEKIINISDKSFYKDLLWLFSLTLQMRNSDADKNIDRLISPVLNEKGFFYDSDLKSDMLPYDADANGAYNIAKKGLWIINQIKSMDDDKVDKLKTISNKEWLQFAQENKL

SEQ ID NO: 573 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNRNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFETSTLLNGWDVNKERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFQFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 574 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNTNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFETSTLLRGWDVNKERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFQFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 575 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNTNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFETSTLLNGWDVNRERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFQFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 576 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNRNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFETSTLLRGWDVNKERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFQFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 577 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNRNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFETSTLLNGWDVNRERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFQFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 578 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNTNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFETSTLLRGWDVNRERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFQFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 579 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNRNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFETSTLLRGWDVNRERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFQFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 580 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNRNRENIYSPEEKSTAVAYRLINENLPKYIANIKTYNQISQILETEIQELKNNIENELFCNIEDLFDIDNYSKFLPQSAIDLYNLVIGGRTQIQGLNEYIALYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFETSTLLNGWDVNRERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFQFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 581 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNTNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFERSTLLNGWDVNKERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFQFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 582 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNTNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFETSTLLNGWDVNKERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFLFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 583 - protein, 1193 aa, synthetic construct
MSINNEFIGLYPVSKTLRFELKPIGKTLENIQKSEIIKQDEDRKDDCKKVKKLMDEYHKFYIEQSLQKCVLNKETMDEYMEYYKSTDEKAKDKLDKIKEKLRKEIVVLFKGSDKLSKEGFIKDILVNHLTDEKDRELVSKFDGFTTYFTGFNTNRENIYSPEEKSTAVAYRLINENLPKYIANIKTYNQISQILETEIQELKNNIENELFCNIEDLFDIDNYSKFLPQSAIDLYNLVIGGRTQIQGLNEYINLYNQRHRTHYPKFVPLFKQILSDKETLSWLPESFSSDNELLEAIENTYREIKENAIHSCKNILSNISDYDLDGIYIKNDTTLTSILKSYYGDWNIINTALEQKYGEKQSEKVKKNKSYSLSFINDLLGKENKKIEDFYKAYGKKETDKLSLFGEIEEKYSKVQTLLNTEYNGNLRENKHQEIENLKEFLDSLKNLLWFFKSLYGEGDEYNRNMKFYSEYETIFVELNKVTPLYDMVRNYLTKKAYSEEKFKLNFERSTLLNGWDVNKERDNLGVLLRKDGLYYLAIMNKSLNNRGRVFKKEAKNSEECYEKIDYKLLPGPNKMLPKVFFAKGRIKEFNPSEELLTKYEKGTHKKGENFNLQDCRDLIDFFKQSIAKHEDWSQFDFHFSKTESYQNINDFYEEVESQGYKLSFRNISSEYINQLVEDGKIYLFQIYKKDFSPYSKGTPNLHTLYWKALFDEYNLKDVVYKLNGQAEIFYRKKSLPDDEKTMTKGHHYEQLKDKFSYPIIKDRRYRVDKFLFHVPITMNFQAKDNENINIRVRNFIKKGGVKHVIGIDRGERHLLYLTLTDLDGNIKQQFSLNEIINEYKGKTYKVDYHKLLQEKEDSRTDAKKNWQKVENIKELKEGYLSQVINKIVKLVIEYNAIVVLENLNMGFKRSRQKIEKQVYQKFEKMLIDKLNYLVDKQKAYNEEGGLLKAYQLTAKFDSFKKLGNQTGFLFYVPATYTSKIDPVTGFINAISIKYESIEKTKLLLNKFDDIRYNEEKDYFEFVVKDYSKFSAKVEQTRLNWTICTYKDRIELFRNKDKNNSWDNRKINLTEEFKNLFENNNINYYDKLKENILKQEDKSFFERLLYLLKLTLQMRNSVTGTQEDYIISPVVDENGNFFDSRNNIESLPKDADANGAYNIARKGIWVINQIKQSDDIEKTKLAMTDKQWLNFVQK

SEQ ID NO: 584 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHRNRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLDGWDENKETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 585 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHENRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLRGWDENKETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 586 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHENRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLDGWDENRETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 587 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHRNRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLRGWDENKETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 588 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHRNRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLDGWDENRETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 589 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHENRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLRGWDENRETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 590 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHRNRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLRGWDENRETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 591 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHRNRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVAEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLDGWDENRETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 592 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHENRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDRAQLLDGWDENKETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFQFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 593 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHENRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDNAQLLDGWDENKETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFLFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 594 - protein, 1279 aa, synthetic construct
MKSLTNLYPVSKTLRFELQPIGKTKENIEKHGILSRDEQRAEDYITVKKYIDEYHKQLIKDRLWNFKLPMKSDSKLNSLQEYQELYELSKRDACQEDRFTELKDNLRAIIAKQLTGGTAYGRIFKKELIREDLIDFLTQEEEKETVRQFADFTTYFTGFHENRKNMYSAEEKSTAIAYRLIHQNLPKFMDNMKAFAKIAKSPVAEKFANIYKEWEDSLNVSCLEEIFQLDYFSETLTQPHIEVYNYIIGKKTKEDGNDVKGINEYVNEYNMRHKDNPLPLLVPLYKQILSDREKLSWIAEEFDSDEKMLSAINESYNSLHDVLMGEENESLRSVLLHIKDYNLERVNINSESLTDISQHIFGRYDVFTNGIKAKLRGKNPKKRNESDESFEDRITKIFKTQKSYSIAYLNNLPQPTMEDGRVRTIEDYFISLGAINIEAKQKINLFAQIENAYHDAFTILKRTDTDDTLSQDKKAVEKIKVLLDAFKDLQHFIKPLLGSGEENEKDELFYGIFQLIWDELEAITPLYNKVRNWLTRKPYSTEKIKLNFDRAQLLDGWDENKETANASIILCKDGLYYLGILNKDYRKLLGMPMPSEGDCYDKVVYKFLKDITTMVPKCTTQKKEVVAHFGQSVEDYVLFDPKTFNAPVTVTKEIFDLNNVLYNGVKKFQIEYLRSTDDSLGYEHAVSTWKSFCMQFLKAYKSTSIYNLASVEQKMNSYSDLSSFYKAVNLLLYNLSYRKVSVDYIHSLTEEGKLYLFRIWNKDFSEFSKGAPNLFTLYWKMIFDERNLDNVVYKLNGQAEVFFRKSSIKPENRVIHPAHRPIDNKNEQNKKRTSTFKYDIIKDYRYTVDKFLFHVPITIGFKSEGQTNINSRVQDIIRRGGFTHIIGIDRGERHLLYLSLIDLRGNIVMQKTLNVISREVRGVTYSTNYRDMLEKREGDNKEARRSWGVIESIKELKEGYLSQAIREIANMMVEYNAIVVLEDLNQGFMRGRQKIERQVYEKFEKMLIDKLNCYVDKQIAPSSIGGALHPLQLTNKFESFRKLGKQSGCLFYIPAWNTSKIDPVTGFVNLFDTRYDTREKARMFFSKFKRIKFNTEKDWFEFAFNYNDFTSKAEGTRTEWTLCTYGERIRQFRNPEKNHNWDDETIVLTDEFKRLFCEYGIDIHGNLKESIVAQSDAKFFRGLLGLMKLLLQMRNSIANSEEDYLLSPVMDEKGCFFDSRDNDGTLPENADANGAYNIARKGLWIIRKIRETAENEKPSLKITNKQWLLFAQSKPYLND

SEQ ID NO: 595 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHRNRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFENPQFMVGWDKNKETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFSLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 596 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHENRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFENPQFMRGWDKNKETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFSLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 597 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHENRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFENPQFMVGWDKNRETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFSLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 598 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHRNRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFENPQFMRGWDKNKETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFSLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 599 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHRNRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFENPQFMVGWDKNRETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFSLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 600 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHENRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFENPQFMRGWDKNRETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFSLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 601 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHRNRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFENPQFMRGWDKNRETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFSLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 602 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHRNRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYIALYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFENPQFMVGWDKNRETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFSLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 603 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHENRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFERPQFMVGWDKNKETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFSLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 604 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHENRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFENPQFMVGWDKNKETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFLLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 605 - protein, 1222 aa, synthetic construct
MKKIDSFINLYPLSKTLQFQLVPQGKTLENFQRNVALLDADKKRAELYKKVKKYIDEYHKEFIDQALSKLNGLDVSGYASLYYKTDKTDADKKALQVEAEKLRKKILDGLKAHPDYKKLFEKEMIKELLPKFLKDATEREEAEFFETFTTYFRGFHENRKNLYTAEEQSTAIPYRCINDNLPKFLDNVKIFRKIEAVLPNEIEELARAHGTTAAGVAAWFSADNFSFVITQKGISAYNELIGGRTEEGKEKIQGLNEYINLYNQTCEKSEKLPKFTQLFKQILSDRIAFSYIPEKFSSDDELLKTVRAFYDEIHENSLKKIKDIFSDFTAYERGGIYVENGAPLTNLSQKLSGNWRAFKDDWESRYDASESGKKPKNMEKYLENREKVWKNTAAFSAAELEDFFGLGKVTEYYQNAVKERLEEVVSSRAAADGILQGDYAKTGKRLAKNDDDIALIKNLLDALKTLERTLQDFSTDASLNGKNERFYADLTEPLDRLSVLDRLYDQTRNYITQKPYSKDKIKLNFERPQFMVGWDKNKETDCQAALLRNGGNYYLAVMDRTAKKTFARYPSEANNGWEKIDYKLLPGPNKMLPKVFFAKSNVEYFAPSSEILRIYENGTFKKGAAFSLEDCQKLIAFYQQSIAKHPDWLKFGFAFKRPTEYADIAEFYKEVEKQGYVLSFLPISEAYIREKVDAGELYLFQIYNKDFSPYSKGKPNLHTLYFKALFDERNLKDVVYKLNGESEMFYRFASIQPEERIVHEKNRPIKNKNPYTVKNKPTSVFAYDLVKDKRFTKDQFLLHVPITLNFSSRGDERINTDVRKALKTSGGNYVIGIDRGERHLIYVTVIDEKGSIVEQFSGNVISGEYDGKRVETDYHALLEKKEAERDAARRAWTTVEKIKDLKEGYVSQLVHKICALVIKYDAVIAMENLNLGFKQGRSKVEKSVYQKFEKMLIDKLNYLVDKNAAAEENGGILRAYQLTEKFESFRKMGTQNGFIFYVPPYLTSKIDPTTGFADLLKPKYKNEADSKAFIEKFDSVVFDETEKTFAFSFNYQNFQKSNADAKGKWTVYANGERIETYRGANGVFEDRVVLLFKAWTALFESVGIDWRNGNLKTAILSQSGKAFFESFMRLLRLTLQMRNSKTRSQEDYLLSPVKNAAGEFYDSRNYGATSALPANADANGAYNIARKALWAIERIKQTDETELSSVSLAISNKEWLAYAQKQ

SEQ ID NO: 606 - protein, 1272 aa, synthetic construct
MSNFSDFTGLFSLSKTLRFELKPVGKTKENIEKNGIIERDNERAIAYKAVKKVIDEYHKAFIDQMLNNFKLDFEKLHEFYRQYNLNPNDASGKEKKKKAMAKVQDEMRKQISERFTKSEQYKRLFGKELIREDLAKFVKMPQYENVIREMPGNESLTDEAVKQIQENIQKDIAQFDDFTTYFVGFYRNRKNMYVADDKATSIAHRMIDENLPKFVDNMDVFERIAASEVASHFNEVYKAFELNVNAVGEMFQLDYFSIVLAQKQIDVYNAIIGELNKHTNLYNQHQQKDKSNKLPKLKPLFKQILSERNSISWLPDEFESDNEMLQSIRKCYQDLKEQVFDPLKTLLGNIKDFDLEHIYLPNDLQLTDIAQKHFGSWSVIRNAVVEDLKASNPQKRNEDAEEYEKRMTKLHDSYSIAYLNGIMQGKVEDFKPIEDYFVGMGAEDNDNGQKLNHFARIENAFTEIKTLLNTKYPEDKNLSQDKTNVEKIKNLLDAIKDLQHFVKPLLDCGTESEKDGRFYGEFTPLWETLDQITPLYNMVRNRMTKKLYSDEKIKLNFDTPTLLNGWPDAQANSGAILKDDKGLYYLAILDSMYRTCLNELESCPAERSEMAIMKYLQGGDMGKNVQNLMRIDGITRKVNGRKEKEGALVGQNVRLENAKNTYLPREINDIRLKQSYLTSSPSFNKKDLALYIEFYIHLVREYYSDYQFSFKNPSEYKSFVEFTDHINQQAYQVKFDPISKEQLFQLVDEGKIYLFQIYNKDFSPFSKGTPNMHTLYWKALFDEKNLADVVYKLNGEAEVFFRKHSLRADKPTHPANQAIANKNIQNKKKESTFAYDLIKDSRYMVDKFQLHVPITMNFKAAGINNINSLVNAYLKESNATHIIGIDRGERHLLYLSLIDMKGNIVEQYSLNEIVNEYNGNTYCTNYHDLLDAKEKQRDEARRSWQTIENIKDLKEGYMSQVVHKIAELMVKYNAIVVLEDLNIGFMRGRQKVEKQVYQKFEKMLIDKLNYLVDKKLDAGATGGVLNAYQLTNKFESFQKMGKQNGFLFYIPAWNTSKMDPTTGFVNLFNTRYENMEKAKAFFGKFDTIRLNSAKGWFEFAFDYDNFTTKAEGTQTKWTLCTYGTRIETKRNPEKNNEFDSVEFDLTERIKKLFAKYQIDVNGNIKEQICNQSDASFYREMLHLLHLTLQMRNSITGTDTDYLISPVQNAQGEFYDSCTCGNNLPKNADANGAYNIARKGLWVVEQIKHADDLTKIKLAISNKEWLRYAQGLD

SEQ ID NO: 607 - protein, 1272 aa, synthetic construct
MSNFSDFTGLFSLSKTLRFELKPVGKTKENIEKNGIIERDNERAIAYKAVKKVIDEYHKAFIDQMLNNFKLDFEKLHEFYRQYNLNPNDASGKEKKKKAMAKVQDEMRKQISERFTKSEQYKRLFGKELIREDLAKFVKMPQYENVIREMPGNESLTDEAVKQIQENIQKDIAQFDDFTTYFVGFYDNRKNMYVADDKATSIAHRMIDENLPKFVDNMDVFERIAASEVASHFNEVYKAFELNVNAVGEMFQLDYFSIVLAQKQIDVYNAIIGELNKHTNLYNQHQQKDKSNKLPKLKPLFKQILSERNSISWLPDEFESDNEMLQSIRKCYQDLKEQVFDPLKTLLGNIKDFDLEHIYLPNDLQLTDIAQKHFGSWSVIRNAVVEDLKASNPQKRNEDAEEYEKRMTKLHDSYSIAYLNGIMQGKVEDFKPIEDYFVGMGAEDNDNGQKLNHFARIENAFTEIKTLLNTKYPEDKNLSQDKTNVEKIKNLLDAIKDLQHFVKPLLDCGTESEKDGRFYGEFTPLWETLDQITPLYNMVRNRMTKKLYSDEKIKLNFDTPTLLRGWPDAQANSGAILKDDKGLYYLAILDSMYRTCLNELESCPAERSEMAIMKYLQGGDMGKNVQNLMRIDGITRKVNGRKEKEGALVGQNVRLENAKNTYLPREINDIRLKQSYLTSSPSFNKKDLALYIEFYIHLVREYYSDYQFSFKNPSEYKSFVEFTDHINQQAYQVKFDPISKEQLFQLVDEGKIYLFQIYNKDFSPFSKGTPNMHTLYWKALFDEKNLADVVYKLNGEAEVFFRKHSLRADKPTHPANQAIANKNIQNKKKESTFAYDLIKDSRYMVDKFQLHVPITMNFKAAGINNINSLVNAYLKESNATHIIGIDRGERHLLYLSLIDMKGNIVEQYSLNEIVNEYNGNTYCTNYHDLLDAKEKQRDEARRSWQTIENIKDLKEGYMSQVVHKIAELMVKYNAIVVLEDLNIGFMRGRQKVEKQVYQKFEKMLIDKLNYLVDKKLDAGATGGVLNAYQLTNKFESFQKMGKQNGFLFYIPAWNTSKMDPTTGFVNLFNTRYENMEKAKAFFGKFDTIRLNSAKGWFEFAFDYDNFTTKAEGTQTKWTLCTYGTRIETKRNPEKNNEFDSVEFDLTERIKKLFAKYQIDVNGNIKEQICNQSDASFYREMLHLLHLTLQMRNSITGTDTDYLISPVQNAQGEFYDSCTCGNNLPKNADANGAYNIARKGLWVVEQIKHADDLTKIKLAISNKEWLRYAQGLD

SEQ ID NO: 608 - protein, 1272 aa, synthetic construct
MSNFSDFTGLFSLSKTLRFELKPVGKTKENIEKNGIIERDNERAIAYKAVKKVIDEYHKAFIDQMLNNFKLDFEKLHEFYRQYNLNPNDASGKEKKKKAMAKVQDEMRKQISERFTKSEQYKRLFGKELIREDLAKFVKMPQYENVIREMPGNESLTDEAVKQIQENIQKDIAQFDDFTTYFVGFYRNRKNMYVADDKATSIAHRMIDENLPKFVDNMDVFERIAASEVASHFNEVYKAFELNVNAVGEMFQLDYFSIVLAQKQIDVYNAIIGELNKHTNLYNQHQQKDKSNKLPKLKPLFKQILSERNSISWLPDEFESDNEMLQSIRKCYQDLKEQVFDPLKTLLGNIKDFDLEHIYLPNDLQLTDIAQKHFGSWSVIRNAVVEDLKASNPQKRNEDAEEYEKRMTKLHDSYSIAYLNGIMQGKVEDFKPIEDYFVGMGAEDNDNGQKLNHFARIENAFTEIKTLLNTKYPEDKNLSQDKTNVEKIKNLLDAIKDLQHFVKPLLDCGTESEKDGRFYGEFTPLWETLDQITPLYNMVRNRMTKKLYSDEKIKLNFDTPTLLRGWPDAQANSGAILKDDKGLYYLAILDSMYRTCLNELESCPAERSEMAIMKYLQGGDMGKNVQNLMRIDGITRKVNGRKEKEGALVGQNVRLENAKNTYLPREINDIRLKQSYLTSSPSFNKKDLALYIEFYIHLVREYYSDYQFSFKNPSEYKSFVEFTDHINQQAYQVKFDPISKEQLFQLVDEGKIYLFQIYNKDFSPFSKGTPNMHTLYWKALFDEKNLADVVYKLNGEAEVFFRKHSLRADKPTHPANQAIANKNIQNKKKESTFAYDLIKDSRYMVDKFQLHVPITMNFKAAGINNINSLVNAYLKESNATHIIGIDRGERHLLYLSLIDMKGNIVEQYSLNEIVNEYNGNTYCTNYHDLLDAKEKQRDEARRSWQTIENIKDLKEGYMSQVVHKIAELMVKYNAIVVLEDLNIGFMRGRQKVEKQVYQKFEKMLIDKLNYLVDKKLDAGATGGVLNAYQLTNKFESFQKMGKQNGFLFYIPAWNTSKMDPTTGFVNLFNTRYENMEKAKAFFGKFDTIRLNSAKGWFEFAFDYDNFTTKAEGTQTKWTLCTYGTRIETKRNPEKNNEFDSVEFDLTERIKKLFAKYQIDVNGNIKEQICNQSDASFYREMLHLLHLTLQMRNSITGTDTDYLISPVQNAQGEFYDSCTCGNNLPKNADANGAYNIARKGLWVVEQIKHADDLTKIKLAISNKEWLRYAQGLD

SEQ ID NO: 609 - protein, 1272 aa, synthetic construct
MSNFSDFTGLFSLSKTLRFELKPVGKTKENIEKNGIIERDNERAIAYKAVKKVIDEYHKAFIDQMLNNFKLDFEKLHEFYRQYNLNPNDASGKEKKKKAMAKVQDEMRKQISERFTKSEQYKRLFGKELIREDLAKFVKMPQYENVIREMPGNESLTDEAVKQIQENIQKDIAQFDDFTTYFVGFYRNRKNMYVADDKATSIAHRMIDENLPKFVDNMDVFERIAASEVASHFNEVYKAFELNVNAVGEMFQLDYFSIVLAQKQIDVYNAIIGELNKHTALYNQHQQKDKSNKLPKLKPLFKQILSERNSISWLPDEFESDNEMLQSIRKCYQDLKEQVFDPLKTLLGNIKDFDLEHIYLPNDLQLTDIAQKHFGSWSVIRNAVVEDLKASNPQKRNEDAEEYEKRMTKLHDSYSIAYLNGIMQGKVEDFKPIEDYFVGMGAEDNDNGQKLNHFARIENAFTEIKTLLNTKYPEDKNLSQDKTNVEKIKNLLDAIKDLQHFVKPLLDCGTESEKDGRFYGEFTPLWETLDQITPLYNMVRNRMTKKLYSDEKIKLNFDTPTLLNGWPDAQANSGAILKDDKGLYYLAILDSMYRTCLNELESCPAERSEMAIMKYLQGGDMGKNVQNLMRIDGITRKVNGRKEKEGALVGQNVRLENAKNTYLPREINDIRLKQSYLTSSPSFNKKDLALYIEFYIHLVREYYSDYQFSFKNPSEYKSFVEFTDHINQQAYQVKFDPISKEQLFQLVDEGKIYLFQIYNKDFSPFSKGTPNMHTLYWKALFDEKNLADVVYKLNGEAEVFFRKHSLRADKPTHPANQAIANKNIQNKKKESTFAYDLIKDSRYMVDKFQLHVPITMNFKAAGINNINSLVNAYLKESNATHIIGIDRGERHLLYLSLIDMKGNIVEQYSLNEIVNEYNGNTYCTNYHDLLDAKEKQRDEARRSWQTIENIKDLKEGYMSQVVHKIAELMVKYNAIVVLEDLNIGFMRGRQKVEKQVYQKFEKMLIDKLNYLVDKKLDAGATGGVLNAYQLTNKFESFQKMGKQNGFLFYIPAWNTSKMDPTTGFVNLFNTRYENMEKAKAFFGKFDTIRLNSAKGWFEFAFDYDNFTTKAEGTQTKWTLCTYGTRIETKRNPEKNNEFDSVEFDLTERIKKLFAKYQIDVNGNIKEQICNQSDASFYREMLHLLHLTLQMRNSITGTDTDYLISPVQNAQGEFYDSCTCGNNLPKNADANGAYNIARKGLWVVEQIKHADDLTKIKLAISNKEWLRYAQGLD

SEQ ID NO: 610 - protein, 1272 aa, synthetic construct
MSNFSDFTGLFSLSKTLRFELKPVGKTKENIEKNGIIERDNERAIAYKAVKKVIDEYHKAFIDQMLNNFKLDFEKLHEFYRQYNLNPNDASGKEKKKKAMAKVQDEMRKQISERFTKSEQYKRLFGKELIREDLAKFVKMPQYENVIREMPGNESLTDEAVKQIQENIQKDIAQFDDFTTYFVGFYDNRKNMYVADDKATSIAHRMIDENLPKFVDNMDVFERIAASEVASHFNEVYKAFELNVNAVGEMFQLDYFSIVLAQKQIDVYNAIIGELNKHTNLYNQHQQKDKSNKLPKLKPLFKQILSERNSISWLPDEFESDNEMLQSIRKCYQDLKEQVFDPLKTLLGNIKDFDLEHIYLPNDLQLTDIAQKHFGSWSVIRNAVVEDLKASNPQKRNEDAEEYEKRMTKLHDSYSIAYLNGIMQGKVEDFKPIEDYFVGMGAEDNDNGQKLNHFARIENAFTEIKTLLNTKYPEDKNLSQDKTNVEKIKNLLDAIKDLQHFVKPLLDCGTESEKDGRFYGEFTPLWETLDQITPLYNMVRNRMTKKLYSDEKIKLNFDRPTLLNGWPDAQANSGAILKDDKGLYYLAILDSMYRTCLNELESCPAERSEMAIMKYLQGGDMGKNVQNLMRIDGITRKVNGRKEKEGALVGQNVRLENAKNTYLPREINDIRLKQSYLTSSPSFNKKDLALYIEFYIHLVREYYSDYQFSFKNPSEYKSFVEFTDHINQQAYQVKFDPISKEQLFQLVDEGKIYLFQIYNKDFSPFSKGTPNMHTLYWKALFDEKNLADVVYKLNGEAEVFFRKHSLRADKPTHPANQAIANKNIQNKKKESTFAYDLIKDSRYMVDKFQLHVPITMNFKAAGINNINSLVNAYLKESNATHIIGIDRGERHLLYLSLIDMKGNIVEQYSLNEIVNEYNGNTYCTNYHDLLDAKEKQRDEARRSWQTIENIKDLKEGYMSQVVHKIAELMVKYNAIVVLEDLNIGFMRGRQKVEKQVYQKFEKMLIDKLNYLVDKKLDAGATGGVLNAYQLTNKFESFQKMGKQNGFLFYIPAWNTSKMDPTTGFVNLFNTRYENMEKAKAFFGKFDTIRLNSAKGWFEFAFDYDNFTTKAEGTQTKWTLCTYGTRIETKRNPEKNNEFDSVEFDLTERIKKLFAKYQIDVNGNIKEQICNQSDASFYREMLHLLHLTLQMRNSITGTDTDYLISPVQNAQGEFYDSCTCGNNLPKNADANGAYNIARKGLWVVEQIKHADDLTKIKLAISNKEWLRYAQGLD

SEQ ID NO: 611 - protein, 1272 aa, synthetic construct
MSNFSDFTGLFSLSKTLRFELKPVGKTKENIEKNGIIERDNERAIAYKAVKKVIDEYHKAFIDQMLNNFKLDFEKLHEFYRQYNLNPNDASGKEKKKKAMAKVQDEMRKQISERFTKSEQYKRLFGKELIREDLAKFVKMPQYENVIREMPGNESLTDEAVKQIQENIQKDIAQFDDFTTYFVGFYDNRKNMYVADDKATSIAHRMIDENLPKFVDNMDVFERIAASEVASHFNEVYKAFELNVNAVGEMFQLDYFSIVLAQKQIDVYNAIIGELNKHTNLYNQHQQKDKSNKLPKLKPLFKQILSERNSISWLPDEFESDNEMLQSIRKCYQDLKEQVFDPLKTLLGNIKDFDLEHIYLPNDLQLTDIAQKHFGSWSVIRNAVVEDLKASNPQKRNEDAEEYEKRMTKLHDSYSIAYLNGIMQGKVEDFKPIEDYFVGMGAEDNDNGQKLNHFARIENAFTEIKTLLNTKYPEDKNLSQDKTNVEKIKNLLDAIKDLQHFVKPLLDCGTESEKDGRFYGEFTPLWETLDQITPLYNMVRNRMTKKLYSDEKIKLNFDTPTLLNGWPDAQANSGAILKDDKGLYYLAILDSMYRTCLNELESCPAERSEMAIMKYLQGGDMGKNVQNLMRIDGITRKVNGRKEKEGALVGQNVRLENAKNTYLPREINDIRLKQSYLTSSPSFNKKDLALYIEFYIHLVREYYSDYQFSFKNPSEYKSFVEFTDHINQQAYQVKFDPISKEQLFQLVDEGKIYLFQIYNKDFSPFSKGTPNMHTLYWKALFDEKNLADVVYKLNGEAEVFFRKHSLRADKPTHPANQAIANKNIQNKKKESTFAYDLIKDSRYMVDKFLLHVPITMNFKAAGINNINSLVNAYLKESNATHIIGIDRGERHLLYLSLIDMKGNIVEQYSLNEIVNEYNGNTYCTNYHDLLDAKEKQRDEARRSWQTIENIKDLKEGYMSQVVHKIAELMVKYNAIVVLEDLNIGFMRGRQKVEKQVYQKFEKMLIDKLNYLVDKKLDAGATGGVLNAYQLTNKFESFQKMGKQNGFLFYIPAWNTSKMDPTTGFVNLFNTRYENMEKAKAFFGKFDTIRLNSAKGWFEFAFDYDNFTTKAEGTQTKWTLCTYGTRIETKRNPEKNNEFDSVEFDLTERIKKLFAKYQIDVNGNIKEQICNQSDASFYREMLHLLHLTLQMRNSITGTDTDYLISPVQNAQGEFYDSCTCGNNLPKNADANGAYNIARKGLWVVEQIKHADDLTKIKLAISNKEWLRYAQGLD

SEQ ID NO: 612 - protein, 1272 aa, synthetic construct
MSNFSDFTGLFSLSKTLRFELKPVGKTKENIEKNGIIERDNERAIAYKAVKKVIDEYHKAFIDQMLNNFKLDFEKLHEFYRQYNLNPNDASGKEKKKKAMAKVQDEMRKQISERFTKSEQYKRLFGKELIREDLAKFVKMPQYENVIREMPGNESLTDEAVKQIQENIQKDIAQFDDFTTYFVGFYDNRKNMYVADDKATSIAHRMIDENLPKFVDNMDVFERIAASEVASHFNEVYKAFELNVNAVGEMFQLDYFSIVLAQKQIDVYNAIIGELNKHTNLYNQHQQKDKSNKLPKLKPLFKQILSERNSISWLPDEFESDNEMLQSIRKCYQDLKEQVFDPLKTLLGNIKDFDLEHIYLPNDLQLTDIAQKHFGSWSVIRNAVVEDLKASNPQKRNEDAEEYEKRMTKLHDSYSIAYLNGIMQGKVEDFKPIEDYFVGMGAEDNDNGQKLNHFARIENAFTEIKTLLNTKYPEDKNLSQDKTNVEKIKNLLDAIKDLQHFVKPLLDCGTESEKDGRFYGEFTPLWETLDQITPLYNMVRNRMTKKLYSDEKIKLNFDRPTLLNGWPDAQANSGAILKDDKGLYYLAILDSMYRTCLNELESCPAERSEMAIMKYLQGGDMGKNVQNLMRIDGITRKVNGRKEKEGALVGQNVRLENAKNTYLPREINDIRLKQSYLTSSPSFNKKDLALYIEFYIHLVREYYSDYQFSFKNPSEYKSFVEFTDHINQQAYQVKFDPISKEQLFQLVDEGKIYLFQIYNKDFSPFSKGTPNMHTLYWKALFDEKNLADVVYKLNGEAEVFFRKHSLRADKPTHPANQAIANKNIQNKKKESTFAYDLIKDSRYMVDKFLLHVPITMNFKAAGINNINSLVNAYLKESNATHIIGIDRGERHLLYLSLIDMKGNIVEQYSLNEIVNEYNGNTYCTNYHDLLDAKEKQRDEARRSWQTIENIKDLKEGYMSQVVHKIAELMVKYNAIVVLEDLNIGFMRGRQKVEKQVYQKFEKMLIDKLNYLVDKKLDAGATGGVLNAYQLTNKFESFQKMGKQNGFLFYIPAWNTSKMDPTTGFVNLFNTRYENMEKAKAFFGKFDTIRLNSAKGWFEFAFDYDNFTTKAEGTQTKWTLCTYGTRIETKRNPEKNNEFDSVEFDLTERIKKLFAKYQIDVNGNIKEQICNQSDASFYREMLHLLHLTLQMRNSITGTDTDYLISPVQNAQGEFYDSCTCGNNLPKNADANGAYNIARKGLWVVEQIKHADDLTKIKLAISNKEWLRYAQGLD

SEQ ID NO: 613 - protein, 1283 aa, synthetic construct
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHRNRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVNLYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDNAQLLDGWDENKETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 614 - protein, 1283 aa, synthetic construct
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHENRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVNLYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDNAQLLRGWDENKETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 615 - protein, 1283 aa, synthetic construct
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHENRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVNLYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDNAQLLDGWDENRETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 616 - protein, 1283 aa, synthetic construct
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHRNRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVNLYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDNAQLLRGWDENKETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 617 - protein, 1283 aa, synthetic construct
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHRNRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVNLYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDNAQLLDGWDENRETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 618 - protein, 1283 aa, synthetic construct
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHENRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVNLYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDNAQLLRGWDENRETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 619 - protein, 1283 aa, synthetic construct
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHRNRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVNLYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDNAQLLRGWDENRETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 620 - protein, 1283 aa, synthetic construct
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHRNRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVALYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDNAQLLDGWDENRETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 621 - protein, 1283 aa, synthetic construct
MNTFNQFTNLYNVQKTLCFELQPVGKTRENIEEDGLLKQDEERAENYKKVKGFIDEYHKQYIKDRLWNYELPLKGEGKRNSLEEYQQFYELSKRDANQEATFTEIKDNLRAIIAKRLTEKGSAYERIFKKELIREDLIEFLDKEEDKELVRQFSDFTTYFTGFHENRANMYKDEEQSTSIAYRLIHQNLPKFMDNIKAFSAIAQTPVAEHFKELYARWESYLNVSSIDEMFRLDYFSHTLTQPHIEVYNSIIGKRILEDGTEIKGINEYVNLYNQQQKDKKLPLFVPLYKQILSDRERLSWLSEEFDSDAKMLKAINECYDHLHDLLMGKENESLCELLKHLTDFNLSQINITNDLSLTDISQSMFGRYDVFTTGLKNTLKISTPQKRDEKEEAYEDRITKLFKACKSFSIAELNGLQLPVAEDGGHKRVEDYFISLGAVGKEKNLFEQIEEAYTEALPILQLKETDDTLSQNKAAVAKIKDLLDAFKNLQHFVKPLLGSGEENEKDEVFYGAFQTLWDELDAVTPLYNKVRNWLTRKPYSTEKIKLNFDRAQLLDGWDENKETANASIILCKDGFYYLGIVKKDNRKLLGMPMPSDGECYDKVVYKFFKDITTMVPKCTTQKKDVVAHFAHSNEDYILFDKKTFNAPVTITKEIYELNNILYNGVKKFQIEYLRSTGDKSGYEHAVFTWKTFCLQFLKAYKSTSIYNLKLVEQHIDSYYDLSSFYSAVNLLLYNLSYRKVSMSYVHSLVEEGKLFLFRIWNKDFSEYSKGTPNLHTLYWKMLFDERNLADVVFKLNGQAEVFYRKASIKQENRIIHPAHQAINNKNPLNRTPTSTFDYDIIKNKRYTVDKFLFHVPITINFKAKGLTNINPLVLDVIRKGGFSHIIGIDRGERHLLYLSLIDLKGNIVKQMTLNEIINVYREQTYVTNYHNLLAQREGDRTKARRSWDTIENIKELKEGYLSQVVHVISKMVVEYHAIVVLEDLNMGFMQSRQKIERQVYEKFEKMLIDKLNCYIYKQVDPTSEGGVLHALQLTNKFESFRKLGKQSGCLFYIPAWNTSKIDPLTGFVNFINPKYESIQAARDLIGKFEDIRYNPEKNYFEFHIKDYAAFNPKAKSSRQEWVICTKGTRIRTFRNPDKNNEWDSEEIVLTEKFKELFDSYGIDYRCNLLASILIQTKKDFFHNEDVKKPSLLSLLKLTLQLRNSHINSEVDYILSPVADAKGSFYDSRTCGSSLPNNADANGAFNIARKGLMLVERIRSIKDDEKPALTITNEEWLHYAQAQ

SEQ ID NO: 622 - protein, 1277 aa, synthetic construct
MDTIEQFTGLYSLSKTLRFELKPIGKTQENIEKSGILKRDSQRAEDYKIVKRFIDEYHKWYIKNRLWSLRLPLKSEGRLDSLEEYQELYTLTKRNAEQEVNFTMVKDNLRSIIAKRLTDNSPAYKRIDKKELIREDLIEFLENEEDKELVRQFADFTTYFTGFHRNRLNMYTDEEKSTAIAYRLIHQNLPKFMDNMKAFAKIAETSVAEHFADIYEGWKEYLNVSSIKEIFQLDYFSETLTQPHIEVYNYIIGKKILADGTEIKGINEYVNLYNQQQKDKSQRLPFLVPLYKQILSDREKLSWMAEGFDSDEKMLSAINESYCHLHDMLMGEENESLRSILSHIKDYNLEQINITNDLSLTDISQHLFSRYDVFTNGIKDELRVITPKKKKESDEDFESRVSKIFKTQKSFSIAALNKLPQPVMEDSKPRYIEDYFMSLGAVNTEATQKENLFAQIENAYEDARAILQMKDTGDALSQNKPAVAKIKALLDAFKNLQHFIKPLLGSGEENEKDELFYGMFQLIWEELDTVTSLYDKVRNWLTRKPYSTEKIKLNFDSPTLLKNMAIPQTSSAAIFRDKRGYYYLGILDSNYRNCLNNLSLDIDSTSDSIEFMNYRQGGDMGKNVQNLMVINGVTRKVNGRKETSGEFVGQNLRLENSKNEYLPAHINAIRQKQSYLKTSATFNKEDLATFIAYYIPLVKEYYSDFVFHFKDPHEYTSFPDFTEHINAQAYQLFFTPISRKQVDQLVEDGKMFLFRIWNKDFSEYSKGTPNLHTLYWRMLFDKRNLSDVVYMLNGQGAEVFYRKASIKPENRIIHQAQCPIANKNELNEKRTSTFEYDIIKDRRYTVDKFQFHVPITIGFKAKGQKNINSNVQDTIRSGGFTHIIGIDRGERHLLYLSLIDLKGNIVKQMTLNDIINEYKGVTHKTNYHDLLAKREGERTDARRSWDTIETIKELKEGYLSQVVHIISKMMVEYNAIVVLEDLNMGFMRGRQKIERQVYEKFEKLLIDKLNCYIDKERDPSSVGGLLHPLQLTNKFESFRKLGKQCGCLFYIPAWNTSKIDPVTGFVNLFDTQYDTREKARLFFSKFQRISFNAEKGWFEFKFDYNDFTTKAEGTRTGWTLCTYGERIRTFRNPQKNNQWDDEKIVLTEEFKQLFGRYGIEIHGNIKEEIFAQSDAQFFRELLGLMKLLLQMRNSRTNSEEDYLLSPVEDEKGHFFDSRENIETLPNNADANGAYNIARKGLWVIRKIQETAENEKISLDISNKEWLQFAQTKPYLSD

SEQ ID NO: 623 - protein, 1277 aa, synthetic construct
MDTIEQFTGLYSLSKTLRFELKPIGKTQENIEKSGILKRDSQRAEDYKIVKRFIDEYHKWYIKNRLWSLRLPLKSEGRLDSLEEYQELYTLTKRNAEQEVNFTMVKDNLRSIIAKRLTDNSPAYKRIDKKELIREDLIEFLENEEDKELVRQFADFTTYFTGFHQNRLNMYTDEEKSTAIAYRLIHQNLPKFMDNMKAFAKIAETSVAEHFADIYEGWKEYLNVSSIKEIFQLDYFSETLTQPHIEVYNYIIGKKILADGTEIKGINEYVNLYNQQQKDKSQRLPFLVPLYKQILSDREKLSWMAEGFDSDEKMLSAINESYCHLHDMLMGEENESLRSILSHIKDYNLEQINITNDLSLTDISQHLFSRYDVFTNGIKDELRVITPKKKKESDEDFESRVSKIFKTQKSFSIAALNKLPQPVMEDSKPRYIEDYFMSLGAVNTEATQKENLFAQIENAYEDARAILQMKDTGDALSQNKPAVAKIKALLDAFKNLQHFIKPLLGSGEENEKDELFYGMFQLIWEELDTVTSLYDKVRNWLTRKPYSTEKIKLNFDSPTLLRNMAIPQTSSAAIFRDKRGYYYLGILDSNYRNCLNNLSLDIDSTSDSIEFMNYRQGGDMGKNVQNLMVINGVTRKVNGRKETSGEFVGQNLRLENSKNEYLPAHINAIRQKQSYLKTSATFNKEDLATFIAYYIPLVKEYYSDFVFHFKDPHEYTSFPDFTEHINAQAYQLFFTPISRKQVDQLVEDGKMFLFRIWNKDFSEYSKGTPNLHTLYWRMLFDKRNLSDVVYMLNGQGAEVFYRKASIKPENRIIHQAQCPIANKNELNEKRTSTFEYDIIKDRRYTVDKFQFHVPITIGFKAKGQKNINSNVQDTIRSGGFTHIIGIDRGERHLLYLSLIDLKGNIVKQMTLNDIINEYKGVTHKTNYHDLLAKREGERTDARRSWDTIETIKELKEGYLSQVVHIISKMMVEYNAIVVLEDLNMGFMRGRQKIERQVYEKFEKLLIDKLNCYIDKERDPSSVGGLLHPLQLTNKFESFRKLGKQCGCLFYIPAWNTSKIDPVTGFVNLFDTQYDTREKARLFFSKFQRISFNAEKGWFEFKFDYNDFTTKAEGTRTGWTLCTYGERIRTFRNPQKNNQWDDEKIVLTEEFKQLFGRYGIEIHGNIKEEIFAQSDAQFFRELLGLMKLLLQMRNSRTNSEEDYLLSPVEDEKGHFFDSRENIETLPNNADANGAYNIARKGLWVIRKIQETAENEKISLDISNKEWLQFAQTKPYLSD

SEQ ID NO: 624 - protein, 1277 aa, synthetic construct
MDTIEQFTGLYSLSKTLRFELKPIGKTQENIEKSGILKRDSQRAEDYKIVKRFIDEYHKWYIKNRLWSLRLPLKSEGRLDSLEEYQELYTLTKRNAEQEVNFTMVKDNLRSIIAKRLTDNSPAYKRIDKKELIREDLIEFLENEEDKELVRQFADFTTYFTGFHRNRLNMYTDEEKSTAIAYRLIHQNLPKFMDNMKAFAKIAETSVAEHFADIYEGWKEYLNVSSIKEIFQLDYFSETLTQPHIEVYNYIIGKKILADGTEIKGINEYVNLYNQQQKDKSQRLPFLVPLYKQILSDREKLSWMAEGFDSDEKMLSAINESYCHLHDMLMGEENESLRSILSHIKDYNLEQINITNDLSLTDISQHLFSRYDVFTNGIKDELRVITPKKKKESDEDFESRVSKIFKTQKSFSIAALNKLPQPVMEDSKPRYIEDYFMSLGAVNTEATQKENLFAQIENAYEDARAILQMKDTGDALSQNKPAVAKIKALLDAFKNLQHFIKPLLGSGEENEKDELFYGMFQLIWEELDTVTSLYDKVRNWLTRKPYSTEKIKLNFDSPTLLRNMAIPQTSSAAIFRDKRGYYYLGILDSNYRNCLNNLSLDIDSTSDSIEFMNYRQGGDMGKNVQNLMVINGVTRKVNGRKETSGEFVGQNLRLENSKNEYLPAHINAIRQKQSYLKTSATFNKEDLATFIAYYIPLVKEYYSDFVFHFKDPHEYTSFPDFTEHINAQAYQLFFTPISRKQVDQLVEDGKMFLFRIWNKDFSEYSKGTPNLHTLYWRMLFDKRNLSDVVYMLNGQGAEVFYRKASIKPENRIIHQAQCPIANKNELNEKRTSTFEYDIIKDRRYTVDKFQFHVPITIGFKAKGQKNINSNVQDTIRSGGFTHIIGIDRGERHLLYLSLIDLKGNIVKQMTLNDIINEYKGVTHKTNYHDLLAKREGERTDARRSWDTIETIKELKEGYLSQVVHIISKMMVEYNAIVVLEDLNMGFMRGRQKIERQVYEKFEKLLIDKLNCYIDKERDPSSVGGLLHPLQLTNKFESFRKLGKQCGCLFYIPAWNTSKIDPVTGFVNLFDTQYDTREKARLFFSKFQRISFNAEKGWFEFKFDYNDFTTKAEGTRTGWTLCTYGERIRTFRNPQKNNQWDDEKIVLTEEFKQLFGRYGIEIHGNIKEEIFAQSDAQFFRELLGLMKLLLQMRNSRTNSEEDYLLSPVEDEKGHFFDSRENIETLPNNADANGAYNIARKGLWVIRKIQETAENEKISLDISNKEWLQFAQTKPYLSD

SEQ ID NO: 625 - protein, 1277 aa, synthetic construct
MDTIEQFTGLYSLSKTLRFELKPIGKTQENIEKSGILKRDSQRAEDYKIVKRFIDEYHKWYIKNRLWSLRLPLKSEGRLDSLEEYQELYTLTKRNAEQEVNFTMVKDNLRSIIAKRLTDNSPAYKRIDKKELIREDLIEFLENEEDKELVRQFADFTTYFTGFHRNRLNMYTDEEKSTAIAYRLIHQNLPKFMDNMKAFAKIAETSVAEHFADIYEGWKEYLNVSSIKEIFQLDYFSETLTQPHIEVYNYIIGKKILADGTEIKGINEYVALYNQQQKDKSQRLPFLVPLYKQILSDREKLSWMAEGFDSDEKMLSAINESYCHLHDMLMGEENESLRSILSHIKDYNLEQINITNDLSLTDISQHLFSRYDVFTNGIKDELRVITPKKKKESDEDFESRVSKIFKTQKSFSIAALNKLPQPVMEDSKPRYIEDYFMSLGAVNTEATQKENLFAQIENAYEDARAILQMKDTGDALSQNKPAVAKIKALLDAFKNLQHFIKPLLGSGEENEKDELFYGMFQLIWEELDTVTSLYDKVRNWLTRKPYSTEKIKLNFDSPTLLKNMAIPQTSSAAIFRDKRGYYYLGILDSNYRNCLNNLSLDIDSTSDSIEFMNYRQGGDMGKNVQNLMVINGVTRKVNGRKETSGEFVGQNLRLENSKNEYLPAHINAIRQKQSYLKTSATFNKEDLATFIAYYIPLVKEYYSDFVFHFKDPHEYTSFPDFTEHINAQAYQLFFTPISRKQVDQLVEDGKMFLFRIWNKDFSEYSKGTPNLHTLYWRMLFDKRNLSDVVYMLNGQGAEVFYRKASIKPENRIIHQAQCPIANKNELNEKRTSTFEYDIIKDRRYTVDKFQFHVPITIGFKAKGQKNINSNVQDTIRSGGFTHIIGIDRGERHLLYLSLIDLKGNIVKQMTLNDIINEYKGVTHKTNYHDLLAKREGERTDARRSWDTIETIKELKEGYLSQVVHIISKMMVEYNAIVVLEDLNMGFMRGRQKIERQVYEKFEKLLIDKLNCYIDKERDPSSVGGLLHPLQLTNKFESFRKLGKQCGCLFYIPAWNTSKIDPVTGFVNLFDTQYDTREKARLFFSKFQRISFNAEKGWFEFKFDYNDFTTKAEGTRTGWTLCTYGERIRTFRNPQKNNQWDDEKIVLTEEFKQLFGRYGIEIHGNIKEEIFAQSDAQFFRELLGLMKLLLQMRNSRTNSEEDYLLSPVEDEKGHFFDSRENIETLPNNADANGAYNIARKGLWVIRKIQETAENEKISLDISNKEWLQFAQTKPYLSD

SEQ ID NO: 626 - protein, 1277 aa, synthetic construct
MDTIEQFTGLYSLSKTLRFELKPIGKTQENIEKSGILKRDSQRAEDYKIVKRFIDEYHKWYIKNRLWSLRLPLKSEGRLDSLEEYQELYTLTKRNAEQEVNFTMVKDNLRSIIAKRLTDNSPAYKRIDKKELIREDLIEFLENEEDKELVRQFADFTTYFTGFHQNRLNMYTDEEKSTAIAYRLIHQNLPKFMDNMKAFAKIAETSVAEHFADIYEGWKEYLNVSSIKEIFQLDYFSETLTQPHIEVYNYIIGKKILADGTEIKGINEYVNLYNQQQKDKSQRLPFLVPLYKQILSDREKLSWMAEGFDSDEKMLSAINESYCHLHDMLMGEENESLRSILSHIKDYNLEQINITNDLSLTDISQHLFSRYDVFTNGIKDELRVITPKKKKESDEDFESRVSKIFKTQKSFSIAALNKLPQPVMEDSKPRYIEDYFMSLGAVNTEATQKENLFAQIENAYEDARAILQMKDTGDALSQNKPAVAKIKALLDAFKNLQHFIKPLLGSGEENEKDELFYGMFQLIWEELDTVTSLYDKVRNWLTRKPYSTEKIKLNFDRPTLLKNMAIPQTSSAAIFRDKRGYYYLGILDSNYRNCLNNLSLDIDSTSDSIEFMNYRQGGDMGKNVQNLMVINGVTRKVNGRKETSGEFVGQNLRLENSKNEYLPAHINAIRQKQSYLKTSATFNKEDLATFIAYYIPLVKEYYSDFVFHFKDPHEYTSFPDFTEHINAQAYQLFFTPISRKQVDQLVEDGKMFLFRIWNKDFSEYSKGTPNLHTLYWRMLFDKRNLSDVVYMLNGQGAEVFYRKASIKPENRIIHQAQCPIANKNELNEKRTSTFEYDIIKDRRYTVDKFQFHVPITIGFKAKGQKNINSNVQDTIRSGGFTHIIGIDRGERHLLYLSLIDLKGNIVKQMTLNDIINEYKGVTHKTNYHDLLAKREGERTDARRSWDTIETIKELKEGYLSQVVHIISKMMVEYNAIVVLEDLNMGFMRGRQKIERQVYEKFEKLLIDKLNCYIDKERDPSSVGGLLHPLQLTNKFESFRKLGKQCGCLFYIPAWNTSKIDPVTGFVNLFDTQYDTREKARLFFSKFQRISFNAEKGWFEFKFDYNDFTTKAEGTRTGWTLCTYGERIRTFRNPQKNNQWDDEKIVLTEEFKQLFGRYGIEIHGNIKEEIFAQSDAQFFRELLGLMKLLLQMRNSRTNSEEDYLLSPVEDEKGHFFDSRENIETLPNNADANGAYNIARKGLWVIRKIQETAENEKISLDISNKEWLQFAQTKPYLSD

SEQ ID NO: 627 - protein, 1277 aa, synthetic construct
MDTIEQFTGLYSLSKTLRFELKPIGKTQENIEKSGILKRDSQRAEDYKIVKRFIDEYHKWYIKNRLWSLRLPLKSEGRLDSLEEYQELYTLTKRNAEQEVNFTMVKDNLRSIIAKRLTDNSPAYKRIDKKELIREDLIEFLENEEDKELVRQFADFTTYFTGFHQNRLNMYTDEEKSTAIAYRLIHQNLPKFMDNMKAFAKIAETSVAEHFADIYEGWKEYLNVSSIKEIFQLDYFSETLTQPHIEVYNYIIGKKILADGTEIKGINEYVNLYNQQQKDKSQRLPFLVPLYKQILSDREKLSWMAEGFDSDEKMLSAINESYCHLHDMLMGEENESLRSILSHIKDYNLEQINITNDLSLTDISQHLFSRYDVFTNGIKDELRVITPKKKKESDEDFESRVSKIFKTQKSFSIAALNKLPQPVMEDSKPRYIEDYFMSLGAVNTEATQKENLFAQIENAYEDARAILQMKDTGDALSQNKPAVAKIKALLDAFKNLQHFIKPLLGSGEENEKDELFYGMFQLIWEELDTVTSLYDKVRNWLTRKPYSTEKIKLNFDSPTLLKNMAIPQTSSAAIFRDKRGYYYLGILDSNYRNCLNNLSLDIDSTSDSIEFMNYRQGGDMGKNVQNLMVINGVTRKVNGRKETSGEFVGQNLRLENSKNEYLPAHINAIRQKQSYLKTSATFNKEDLATFIAYYIPLVKEYYSDFVFHFKDPHEYTSFPDFTEHINAQAYQLFFTPISRKQVDQLVEDGKMFLFRIWNKDFSEYSKGTPNLHTLYWRMLFDKRNLSDVVYMLNGQGAEVFYRKASIKPENRIIHQAQCPIANKNELNEKRTSTFEYDIIKDRRYTVDKFLFHVPITIGFKAKGQKNINSNVQDTIRSGGFTHIIGIDRGERHLLYLSLIDLKGNIVKQMTLNDIINEYKGVTHKTNYHDLLAKREGERTDARRSWDTIETIKELKEGYLSQVVHIISKMMVEYNAIVVLEDLNMGFMRGRQKIERQVYEKFEKLLIDKLNCYIDKERDPSSVGGLLHPLQLTNKFESFRKLGKQCGCLFYIPAWNTSKIDPVTGFVNLFDTQYDTREKARLFFSKFQRISFNAEKGWFEFKFDYNDFTTKAEGTRTGWTLCTYGERIRTFRNPQKNNQWDDEKIVLTEEFKQLFGRYGIEIHGNIKEEIFAQSDAQFFRELLGLMKLLLQMRNSRTNSEEDYLLSPVEDEKGHFFDSRENIETLPNNADANGAYNIARKGLWVIRKIQETAENEKISLDISNKEWLQFAQTKPYLSD

SEQ ID NO: 628 - protein, 1277 aa, synthetic construct
MDTIEQFTGLYSLSKTLRFELKPIGKTQENIEKSGILKRDSQRAEDYKIVKRFIDEYHKWYIKNRLWSLRLPLKSEGRLDSLEEYQELYTLTKRNAEQEVNFTMVKDNLRSIIAKRLTDNSPAYKRIDKKELIREDLIEFLENEEDKELVRQFADFTTYFTGFHQNRLNMYTDEEKSTAIAYRLIHQNLPKFMDNMKAFAKIAETSVAEHFADIYEGWKEYLNVSSIKEIFQLDYFSETLTQPHIEVYNYIIGKKILADGTEIKGINEYVNLYNQQQKDKSQRLPFLVPLYKQILSDREKLSWMAEGFDSDEKMLSAINESYCHLHDMLMGEENESLRSILSHIKDYNLEQINITNDLSLTDISQHLFSRYDVFTNGIKDELRVITPKKKKESDEDFESRVSKIFKTQKSFSIAALNKLPQPVMEDSKPRYIEDYFMSLGAVNTEATQKENLFAQIENAYEDARAILQMKDTGDALSQNKPAVAKIKALLDAFKNLQHFIKPLLGSGEENEKDELFYGMFQLIWEELDTVTSLYDKVRNWLTRKPYSTEKIKLNFDRPTLLKNMAIPQTSSAAIFRDKRGYYYLGILDSNYRNCLNNLSLDIDSTSDSIEFMNYRQGGDMGKNVQNLMVINGVTRKVNGRKETSGEFVGQNLRLENSKNEYLPAHINAIRQKQSYLKTSATFNKEDLATFIAYYIPLVKEYYSDFVFHFKDPHEYTSFPDFTEHINAQAYQLFFTPISRKQVDQLVEDGKMFLFRIWNKDFSEYSKGTPNLHTLYWRMLFDKRNLSDVVYMLNGQGAEVFYRKASIKPENRIIHQAQCPIANKNELNEKRTSTFEYDIIKDRRYTVDKFLFHVPITIGFKAKGQKNINSNVQDTIRSGGFTHIIGIDRGERHLLYLSLIDLKGNIVKQMTLNDIINEYKGVTHKTNYHDLLAKREGERTDARRSWDTIETIKELKEGYLSQVVHIISKMMVEYNAIVVLEDLNMGFMRGRQKIERQVYEKFEKLLIDKLNCYIDKERDPSSVGGLLHPLQLTNKFESFRKLGKQCGCLFYIPAWNTSKIDPVTGFVNLFDTQYDTREKARLFFSKFQRISFNAEKGWFEFKFDYNDFTTKAEGTRTGWTLCTYGERIRTFRNPQKNNQWDDEKIVLTEEFKQLFGRYGIEIHGNIKEEIFAQSDAQFFRELLGLMKLLLQMRNSRTNSEEDYLLSPVEDEKGHFFDSRENIETLPNNADANGAYNIARKGLWVIRKIQETAENEKISLDISNKEWLQFAQTKPYLSD

SEQ ID NO: 629 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHRNRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLDGWDLNKETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 630 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHENRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLRGWDLNKETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 631 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHENRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLDGWDLNRETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 632 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHRNRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLRGWDLNKETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 633 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHRNRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLDGWDLNRETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 634 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHENRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLRGWDLNRETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 635 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHRNRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLRGWDLNRETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 636 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHRNRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYIALYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLDGWDLNRETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 637 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHENRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFERSTLLDGWDLNKETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFHFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 638 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHENRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFENSTLLDGWDLNKETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFLFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 639 - protein, 1258 aa, synthetic construct
MKRFTNLYQLSKTLRFELKPIGKTLENIEKHGLLEQDTHRAESYVKVKDIIDEYHKAFIEEYLNTFADSSETYAEQNKNFVKLLQELYTNYMCKTKDETQQKLLTESQAKLRKIIAKSFNNDKYKRLFGKELIKEELIDFLKDDVEDITLVQEFKDFTTYFTGFHENRKNMYSDEDKSTAIAYRLIHENLPRFIDNILVFEKIAQSDVAQKFTELYKNFQSYLNVKEISEMFKLGYYNMVLTQTQIDVYNAIIGGKTIEDNDIKIKGLNEYINLYNQQQEDKHNRLPKLKPLYKQILSDRNAISWLPEQFDANEKGGKVLEAIQKAYNELEQQILNNSNEAEHSLPELLKLLSNYDLNKIYIPNDAQLTDISQKVYGHWNIISKALIEDLKLTTPRKSRKETDEKYEERLNKILKSQSSFSIRKITDSVHNTYPEIKSSIITYFENIGNIDNEEENIISKITNSYNIAKDLLNTPYLGNNLSQDTVNVEKIKNLLDAIKDLQHFIKPLLGKGDESEKDEKFYGEFTLLWDELNNITPLYNMVRNYMTRKPYSTEKIKLNFERSTLLDGWDLNKETDNTSVILRKDGMYYLAIMNKKHNRVFNIDSIPTEGDCFEKMEYKLLPGANKMLPKVFFSKSRIDEFAPSKQLIEKYQSGTHKKGDNFSLIDCHNLINFFKDSINKHEDWKKFNFNFSDTNTYEDLSNFYREVEKQGYKISFRNVSSEYINSLVEDGKIYLFQIYNKDFSSYSKGTPNMHTLYWKMLFDETNMSDVCYKLNGQAEIFFRKSSIKAEHPTHPANQPIENKNTLSNKKQSVFTYDLIKDKRYTIDKFLFHVPITMNFKGIGINNINNIVNQFIQEQEDLHIIGIDRGERHLLYLTVIDLQGNIKEQYSLNEIINNYNGNTYKTNYHDLLEKREKERMDARQSWKSIESIKELKEGYLSQVIHKITKLMIKYNAIVVLEDLNIGFMRGRQKVEASVYQKFEKMLIDKLNYLVDKKKQPEELGGTLNALQLTNKFESFQKLGKQSGFLFYTQAWNTSKIDPVTGFVNLFDTRYETREKAKEFFKKFDSICYNSEKDWFEFSFDYNNFTTKAEGTRTNWTLCTYGKRIETFRDEKQNSQWASNEINLTDKFKEFFAKYNIDINANLKESITAQESADFFKGILALLKLTLQMRNSMTGTDVDYLQSPVADNNGVFFNSQECDNSLPQNADANGAYNIARKGLWIVNKIKISNDLSNLNFAISNKEWLQFAQEKPYLLND

SEQ ID NO: 640 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHRNRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGTPTLLNGWDVNKETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFQLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 641 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHENRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGTPTLLRGWDVNKETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFQLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 642 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHENRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGTPTLLNGWDVNRETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFQLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 643 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHRNRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGTPTLLRGWDVNKETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFQLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 644 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHRNRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGTPTLLNGWDVNRETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFQLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 645 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHENRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGTPTLLRGWDVNRETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFQLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 646 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHRNRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGTPTLLRGWDVNRETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFQLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 647 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHRNRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVALFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGTPTLLNGWDVNRETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFQLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 648 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHENRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGRPTLLNGWDVNKETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFQLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 649 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHENRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGTPTLLNGWDVNKETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFLLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 650 - protein, 1321 aa, synthetic construct
MEPLDYNNFTNLYSLSKTLRFELKPIGETADYIEDFKSQNLKDFVTEDQQRAEDYKAIKELIDDYHRAYIEDKLSSPVDPKTGEMWINPQDLEYAYSHYENLKQDQKDPKNRKLWEYTQTALRKKLVKSFAGNSDLFKKELINRDLPNWLEQKGKWEEHKATIESFKKFTTYFSGFHENRKNMYSNEEQPTAIAYRLINENLPRFFNNYIQYKKMVDEYKDLKLTATPALLEKMRVESLDEIFKPRYFINLFTQTGIDNYQQLLGGKTEETGEKEQGLNEQVNLFKQQIQKQAKEHAKKSGEKATKIYDLSGFTGLYKQILSDRETTSFIPEAFDDDKRLLITLAEHIENVTKNNGLLNKLEEAIAQLASTDLQRVYIKSVGLTAISQNLFHRYQIINLALKYYAKKELSAKDCEIYLGQKAFSIAELDEKLISYIQSLEDNDPLHEQLKKLTMPQHPLQGYLLEAVKLAQTKQDNRPELNDAISEVKQLLSLDELSKNRKTPVKEGENGGVGFRQVQKIKGMLDGFMAVSDAVKPLHLVDGRNHIDMPDMDAGFYGGFSEAYNNYTEATITLYNKTRNHLTKKPFSTDKIKVNFGRPTLLNGWDVNKETDNSSILFEKDGLYYLGIMHPKHKHLFNYTKGIDDAGNDKKLKTKDTLNKKVTETDIGGYRKIVYKLLPGANKMLPKVFFSNKRIDYFSPSSEVRKIRNTASHSINGTPRPGFNKEDFSLEDCHTMIDFFKVSIKKHPEWTEFNFQFSDTNSYEDLSGFYREVESQGYRMDFHKIKESYINECIEAGKLFLFQIYNKDFSPYSKGNPNLHTLYWKGLFEAENLKDVVLKLNGEAEIFYRKHSIKRKDIITHTANEAIANKNSENPKKESTFAYDIVKDKRYTKDKFLLHVPITLNFKAQSVSRFNDHVNKALQGNSGTHIIGIDRGERHLLYYTVINDKGEIIEQNTLNSISTDQGYAVDYQQKLHTKEKQRDVARKSWGSVEDIKELKEGYLSHVVHKLAELIIKYNAIICLEDLNFGFKRGRFHVEKQVYQKFEKALIVKLNYLVFKQNEATKPGGYLNAYQLTAPFISFDKLGKQSGILFYVQAAYTSKIDPATGFINFLYTQYQSLAKSKQFFEAFESINFNSNKNYFEFSFDYNNFNVRQNLKDYQTKWIACTHGDVRYSNKRNQQGQWETISINVTEQLKALFNEASISYQNGQDLKQALASAKNTRFYKSLYWLIKLTLSLRHSVTGTDEDFILSPIADKNGVFFDSRNATKQQPKDADANGAYNIALKGLWNLQQIKQWDGEENLKLAMKNEDWFKFINDWHNK

SEQ ID NO: 651 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNRNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDNPQFLKGWPTSLEIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFSLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 652 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNKNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDNPQFLRGWPTSLEIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFSLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 653 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNKNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDNPQFLKGWPTSREIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFSLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 654 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNRNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDNPQFLRGWPTSLEIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFSLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 655 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNRNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDNPQFLKGWPTSREIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFSLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 656 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNKNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDNPQFLRGWPTSREIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFSLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 657 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNRNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDNPQFLRGWPTSREIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFSLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 658 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNRNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIALYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDNPQFLKGWPTSREIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFSLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 659 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNKNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDRPQFLKGWPTSLEIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFSLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 660 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNKNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDNPQFLKGWPTSLEIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFLLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 661 - protein, 1254 aa, synthetic construct
MKKIDSFINKYPLTKTLRFSLIPVGKTEENFNNALLLKKDKQRGEDYKKVKEYIDRYHKEFIEKVLSKVYLEDVKEYADLYYNDSKTDKESERMKSLEDNMRKVISKAFKNDKIYSSLFKKDLIEDVLPRFLENNEEKKLVESFQNFFGYFGGFNKNRENMYTEKARSTAIAYRCINDNLPKFLDNSLTFNKVKELLSKEDLSLMDKTCMELYGVYVYDVFMLDYFNFTLSQSGIGKYNSIIGGYVTDEGVKIKGLNEYIDLYNKQVEKNDKSKKLPFMKKLYKQILIDNEKISFIPESFESGNSVIHSINTYFTDHLDTAIKEVGALFEKFEEFNMDGVFLKAGNAITDISNHVFGDWSAISKSWNAEYEEVHPIKKAKDIEKYFENERKEYNKVKSFAILRLQRLGEKFKTESAPGDIVKFYKNSVKEKIEAVLKEYNNSRDFLKTDYNANNTKKLYRNEDKIKIIKELLDSVKELEHLIKPLLGTGKESGKDEVFYGEFLQAYEQISLVDGLYDRVRNYITQKPYSANKIKLNFDRPQFLKGWPTSLEIERSAQILLTENNEYYLAVINKEYNSIIRKGYNNPADKDDVMMKMCYEQMASPSKDIPNLMFVNGVAKKVNGRKDSDGINRRLENEKTKNLPTEVNDIRLRCGYSVNLNNATRDEVTRFIDYYIKVTEGYYNNFKFNFKKASEYSSYSEFVSDADNQAYQINFQMISKNQISDYVEKGYLYLFRIYNKDFSEHSHGNPNLHTLYFKMLFDEKNLADVVYQLSGGAEMFYREAKIDKDEMIVHKANEPIKNKNKSNPKKESVFKYDLIKDERFTKNQFLLHLPITLNFKADGQKFINSDVRQALKNADSNYVIGIDRGERNLLYICVIDNNGKIIYQKSLNEIISGKDKDYKVDYHKLLDSKENDRDDARKSWRTIENIKELKEGYLSQVVHEICNLVLKYDAIIAMEDLNFGFKKGRFKVEKQVYQKFENMLISKLNFLVSKSAKPEENGGLLNAYQLTNKVDGVNKAKQNGFIFYVPAWLTSKIDPVTGFADLLKPRYTNITESKTLVENIDDIRYNPNDNMFEFDIDYEKFPKAFASYRKLWTVYTNGERIINYHNKDKNNQWDNKTIVLTEEFKALFDKYGIDYSNNLKEQIISQTTSEFFKDFIRLFANTLQMRNSETGNGDVDYLISPVKDECGNFYDSRNFVGEESQLPENADANGAYNIARKAQWAISVLKNTSEDDLKKEVKSIKNSQWLEYVQK

SEQ ID NO: 662 - protein, 1307 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYRNRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSNPTLADGWDENKEQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 663 - protein, 1307 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYENRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSNPTLARGWDENKEQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 664 - protein, 1307 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYENRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSNPTLADGWDENREQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 665 - protein, 1307 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYRNRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSNPTLARGWDENKEQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 666 - protein, 1307 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYRNRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSNPTLADGWDENREQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 667 - protein, 1307 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYENRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSNPTLARGWDENREQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 668 - protein, 1307 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYRNRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSNPTLARGWDENREQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 669 - protein, 1307 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYRNRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLALAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSNPTLADGWDENREQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 670 - protein, 1307 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYENRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSRPTLADGWDENKEQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 671 - protein, 1307 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYENRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSNPTLADGWDENKEQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFLFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 672 - protein, 1306 aa, synthetic construct
MSNFSEFTHKYQVSKTLRFELIPQGKTLENLTAYGMVNDDKLRSENYKKLKPVIDKIYKYFIEETLKHVAIDWEPLYKAITAFRKDKTLENNTNLREIQDNCRKSIAGYFEGKVPDNGNKGLKEFNKAQSRLFKELFGKELFSDSLSEQLPGLSLSDEEKGLLKSFDKFTTYFVGFYENRKNVFSAEDIATSIPHRLVQENFPKFIDDCEIYHRIIKHAPELNLKLETAAAATKLFEGVTLDEIFSVNFYNCLLQQEQIDSFNQLLGGIAGEAGRQKVQGLNETLNLAVQQDKKLEEKIKTIPHRFIPLYKQILSDRSTLSFIPDAFLNDQEVLFAVKEYKEKLAANRVIQKVQALLDGLNLADLTHVYINSSKLTDFSQVVFGEWNLCRDSLQNWKVNNADKKLTKNDLKEIEGWLKGDMALAEIQEALADDKLIQKISAKINAIIDELDTTMKEPLPQYLKSAEDKEILKVLLDAVQKFYHTLNWFTVDDDVETDAGFYVTLAEIMLTVEPIIPLYNKVRNFATQKPYSVEKFKLNFSRPTLADGWDENKEQQNCAILFEKEGKYYLGILNTKNKPDFSKIERAGKNGCYRKMTYKQFPDFSKMLPKCTTQLKDVKQHFISEKTDYILNNKNFIKPLTITKEIYDLNNVLFDGKKKFQIDYLRKTNDKTGYYKALHAWIDFAKAFVVSYKSTAIYDISSVLPTEKYEKLNDFYGELDNLFYQIKFEDIPEQTIDQLVDEGKLFLFQIYNKDFAEGATGAPNLHTIYWKALFDSENMKDVVVKLNGQAELFYRPKSPMEVVRHKVGEKLVNRTLKNGLSLTDELHNEIYLYANGKLKKELSHEAKAFLPQTVIYDVHHEIVKDRRFTTDKFFHVPLTLNYKCDKNPVKFNDAVQEYLKENPDTYVIGIDRGERNLIYAVVINPEGRIIEQKSFNVINGFDYQNKLDQREKERIKARQAWTAVGKIKELKQGYLSLVIHEISKMMVQYQAVVVLENLNSGFKRVRSGIAEKSVYQQFEKMLINKLNYLMFKDIKGTEPGSVLNAYQLTDQFESFAKMRNQSGFLFYVPAAFTSKIDPATGFVDPFRWGVIKTLADKKDFISGFDFLKYNVENGNFTLHFNAGSNKSFQKKLDGFMPDWEIIIEANKERKAADGTAFIAGKRIEFVRENNIAGQYEDYLPCEKLKDVLQKFGIAYEKGNNLLPLILETDNSKLISEVFKAIRLTLQMRNSNAETGEDYISSPVEDIAGNCFDSRMADSALPKDADANGAYHIALKGLLALERMRDGEKQATAISNNDWLNYIQEKRA

SEQ ID NO: 673 - protein, 1346 aa, synthetic construct
METIDSFCGQKNGYSISKTLRFELKPVGQTLESIKNGKFLESDKKKADDYQDVKKIIDNYHNFFIDDVLKSASFDWRQLEKSIHEYNKNKTDDSEFVKEQDKLRKGIADLFSKDKRYKSLTASTPSDLFNKDKDFIDWLAQTSVKEIRKDALETFKRFSSYFTGFQRNRKNVYKSDLIPTAVPYRIVNDNFPKFLQNISIFKTIQKKCPQVIDDVENELCRYLGQEKLSDIFRLESFNKFLGQSGKEVQRGIDFYNQIIGGIAEKEGGVNLRGINQFLNLYWQQHPDFAKENRRVKMVPLYKQILSDRSSLSFKIESIANDEELKNALLECADKLESQNEEGKSVFDETCDLFASLKNQNLSGIYINRKDINAVSRILTGDWSWLQSRMNAYAKEKFTTKAEKARWQKSLDDEGENKSKGFYSLAELNELLEYVSENVAETNIRISDYFDHRCRYYVDKETEKFVQGSELVALSIKEMCDSILAKRKSMNGVLENLSDEKLLQEKPEDVAVIKDYLDAVQELLHRIKPLKVNGVGDAAFYSVFDSIYSALSEVISVYNKTRNYITKKAASPEKYKLNFESPTCANGWALNNELMYGCILLRKQDKYYLGIMNKDEHKFFKKYPLAKPRDDFFEKMIYLQAADPSKDVPNLMVINGKTVKKNGRKDSDGVNRQLEELRNTYLPENINKIRKSKSYLKSSETFSKEDLTEYIEYYKERAIDYFNSYKFFFKNSADYTSFVEFTDDINAQAYQIQFVKITTSFITQMVNGGKLFLFQIYNKDFSEKSNGKKNLHTLYFENLFSEENLKNTVLKLSAGAELFYRPAGIKEPTVHAKGSYLVNRTTEDGEAIPENIYLEIYKNANGKLESLSDEAKAYKESHKVVIKKAGHEIIKDRHYTEPKFLFHVPLTINFKASGNSYSINENVRRFLKNNPDVNIIGLDRGERHLIYLSLINQKGEIIKQFTFNDVEREQNGQIVKVNYHEKLDQREKVRDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGMLFYVPAGYTSKIDPKTGFVSMMNFKDLTNVHKKRDFFAKFDDIHFDNATGSFVFTFDYKNFDGKAKEEMKQTKWSVYSRDKRIVYFSKTKSYEDIMPTEKLRALFESAGIEYKSSNDILDSIMAVGADLKDGAKPSREIADFWDGLLYNFKLILQMRNSNAKTSEDYIISPVMASDGTFFDSREEFDKGKDAKLPLDADANGAYHIALKGLSLIKKINLSKDAELKKFDMKISNADWFKFVQQKEYTK

SEQ ID NO: 674 - protein, 1346 aa, synthetic construct
METIDSFCGQKNGYSISKTLRFELKPVGQTLESIKNGKFLESDKKKADDYQDVKKIIDNYHNFFIDDVLKSASFDWRQLEKSIHEYNKNKTDDSEFVKEQDKLRKGIADLFSKDKRYKSLTASTPSDLFNKDKDFIDWLAQTSVKEIRKDALETFKRFSSYFTGFQENRKNVYKSDLIPTAVPYRIVNDNFPKFLQNISIFKTIQKKCPQVIDDVENELCRYLGQEKLSDIFRLESFNKFLGQSGKEVQRGIDFYNQIIGGIAEKEGGVNLRGINQFLNLYWQQHPDFAKENRRVKMVPLYKQILSDRSSLSFKIESIANDEELKNALLECADKLESQNEEGKSVFDETCDLFASLKNQNLSGIYINRKDINAVSRILTGDWSWLQSRMNAYAKEKFTTKAEKARWQKSLDDEGENKSKGFYSLAELNELLEYVSENVAETNIRISDYFDHRCRYYVDKETEKFVQGSELVALSIKEMCDSILAKRKSMNGVLENLSDEKLLQEKPEDVAVIKDYLDAVQELLHRIKPLKVNGVGDAAFYSVFDSIYSALSEVISVYNKTRNYITKKAASPEKYKLNFESPTCARGWALNNELMYGCILLRKQDKYYLGIMNKDEHKFFKKYPLAKPRDDFFEKMIYLQAADPSKDVPNLMVINGKTVKKNGRKDSDGVNRQLEELRNTYLPENINKIRKSKSYLKSSETFSKEDLTEYIEYYKERAIDYFNSYKFFFKNSADYTSFVEFTDDINAQAYQIQFVKITTSFITQMVNGGKLFLFQIYNKDFSEKSNGKKNLHTLYFENLFSEENLKNTVLKLSAGAELFYRPAGIKEPTVHAKGSYLVNRTTEDGEAIPENIYLEIYKNANGKLESLSDEAKAYKESHKVVIKKAGHEIIKDRHYTEPKFLFHVPLTINFKASGNSYSINENVRRFLKNNPDVNIIGLDRGERHLIYLSLINQKGEIIKQFTFNDVEREQNGQIVKVNYHEKLDQREKVRDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGMLFYVPAGYTSKIDPKTGFVSMMNFKDLTNVHKKRDFFAKFDDIHFDNATGSFVFTFDYKNFDGKAKEEMKQTKWSVYSRDKRIVYFSKTKSYEDIMPTEKLRALFESAGIEYKSSNDILDSIMAVGADLKDGAKPSREIADFWDGLLYNFKLILQMRNSNAKTSEDYIISPVMASDGTFFDSREEFDKGKDAKLPLDADANGAYHIALKGLSLIKKINLSKDAELKKFDMKISNADWFKFVQQKEYTK

SEQ ID NO: 675 - protein, 1346 aa, synthetic construct
METIDSFCGQKNGYSISKTLRFELKPVGQTLESIKNGKFLESDKKKADDYQDVKKIIDNYHNFFIDDVLKSASFDWRQLEKSIHEYNKNKTDDSEFVKEQDKLRKGIADLFSKDKRYKSLTASTPSDLFNKDKDFIDWLAQTSVKEIRKDALETFKRFSSYFTGFQENRKNVYKSDLIPTAVPYRIVNDNFPKFLQNISIFKTIQKKCPQVIDDVENELCRYLGQEKLSDIFRLESFNKFLGQSGKEVQRGIDFYNQIIGGIAEKEGGVNLRGINQFLNLYWQQHPDFAKENRRVKMVPLYKQILSDRSSLSFKIESIANDEELKNALLECADKLESQNEEGKSVFDETCDLFASLKNQNLSGIYINRKDINAVSRILTGDWSWLQSRMNAYAKEKFTTKAEKARWQKSLDDEGENKSKGFYSLAELNELLEYVSENVAETNIRISDYFDHRCRYYVDKETEKFVQGSELVALSIKEMCDSILAKRKSMNGVLENLSDEKLLQEKPEDVAVIKDYLDAVQELLHRIKPLKVNGVGDAAFYSVFDSIYSALSEVISVYNKTRNYITKKAASPEKYKLNFESPTCANGWALNRELMYGCILLRKQDKYYLGIMNKDEHKFFKKYPLAKPRDDFFEKMIYLQAADPSKDVPNLMVINGKTVKKNGRKDSDGVNRQLEELRNTYLPENINKIRKSKSYLKSSETFSKEDLTEYIEYYKERAIDYFNSYKFFFKNSADYTSFVEFTDDINAQAYQIQFVKITTSFITQMVNGGKLFLFQIYNKDFSEKSNGKKNLHTLYFENLFSEENLKNTVLKLSAGAELFYRPAGIKEPTVHAKGSYLVNRTTEDGEAIPENIYLEIYKNANGKLESLSDEAKAYKESHKVVIKKAGHEIIKDRHYTEPKFLFHVPLTINFKASGNSYSINENVRRFLKNNPDVNIIGLDRGERHLIYLSLINQKGEIIKQFTFNDVEREQNGQIVKVNYHEKLDQREKVRDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGMLFYVPAGYTSKIDPKTGFVSMMNFKDLTNVHKKRDFFAKFDDIHFDNATGSFVFTFDYKNFDGKAKEEMKQTKWSVYSRDKRIVYFSKTKSYEDIMPTEKLRALFESAGIEYKSSNDILDSIMAVGADLKDGAKPSREIADFWDGLLYNFKLILQMRNSNAKTSEDYIISPVMASDGTFFDSREEFDKGKDAKLPLDADANGAYHIALKGLSLIKKINLSKDAELKKFDMKISNADWFKFVQQKEYTK

SEQ ID NO: 676 - protein, 1346 aa, synthetic construct
METIDSFCGQKNGYSISKTLRFELKPVGQTLESIKNGKFLESDKKKADDYQDVKKIIDNYHNFFIDDVLKSASFDWRQLEKSIHEYNKNKTDDSEFVKEQDKLRKGIADLFSKDKRYKSLTASTPSDLFNKDKDFIDWLAQTSVKEIRKDALETFKRFSSYFTGFQRNRKNVYKSDLIPTAVPYRIVNDNFPKFLQNISIFKTIQKKCPQVIDDVENELCRYLGQEKLSDIFRLESFNKFLGQSGKEVQRGIDFYNQIIGGIAEKEGGVNLRGINQFLNLYWQQHPDFAKENRRVKMVPLYKQILSDRSSLSFKIESIANDEELKNALLECADKLESQNEEGKSVFDETCDLFASLKNQNLSGIYINRKDINAVSRILTGDWSWLQSRMNAYAKEKFTTKAEKARWQKSLDDEGENKSKGFYSLAELNELLEYVSENVAETNIRISDYFDHRCRYYVDKETEKFVQGSELVALSIKEMCDSILAKRKSMNGVLENLSDEKLLQEKPEDVAVIKDYLDAVQELLHRIKPLKVNGVGDAAFYSVFDSIYSALSEVISVYNKTRNYITKKAASPEKYKLNFESPTCARGWALNNELMYGCILLRKQDKYYLGIMNKDEHKFFKKYPLAKPRDDFFEKMIYLQAADPSKDVPNLMVINGKTVKKNGRKDSDGVNRQLEELRNTYLPENINKIRKSKSYLKSSETFSKEDLTEYIEYYKERAIDYFNSYKFFFKNSADYTSFVEFTDDINAQAYQIQFVKITTSFITQMVNGGKLFLFQIYNKDFSEKSNGKKNLHTLYFENLFSEENLKNTVLKLSAGAELFYRPAGIKEPTVHAKGSYLVNRTTEDGEAIPENIYLEIYKNANGKLESLSDEAKAYKESHKVVIKKAGHEIIKDRHYTEPKFLFHVPLTINFKASGNSYSINENVRRFLKNNPDVNIIGLDRGERHLIYLSLINQKGEIIKQFTFNDVEREQNGQIVKVNYHEKLDQREKVRDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGMLFYVPAGYTSKIDPKTGFVSMMNFKDLTNVHKKRDFFAKFDDIHFDNATGSFVFTFDYKNFDGKAKEEMKQTKWSVYSRDKRIVYFSKTKSYEDIMPTEKLRALFESAGIEYKSSNDILDSIMAVGADLKDGAKPSREIADFWDGLLYNFKLILQMRNSNAKTSEDYIISPVMASDGTFFDSREEFDKGKDAKLPLDADANGAYHIALKGLSLIKKINLSKDAELKKFDMKISNADWFKFVQQKEYTK

SEQ ID NO: 677 - protein, 1346 aa, synthetic construct
METIDSFCGQKNGYSISKTLRFELKPVGQTLESIKNGKFLESDKKKADDYQDVKKIIDNYHNFFIDDVLKSASFDWRQLEKSIHEYNKNKTDDSEFVKEQDKLRKGIADLFSKDKRYKSLTASTPSDLFNKDKDFIDWLAQTSVKEIRKDALETFKRFSSYFTGFQRNRKNVYKSDLIPTAVPYRIVNDNFPKFLQNISIFKTIQKKCPQVIDDVENELCRYLGQEKLSDIFRLESFNKFLGQSGKEVQRGIDFYNQIIGGIAEKEGGVNLRGINQFLNLYWQQHPDFAKENRRVKMVPLYKQILSDRSSLSFKIESIANDEELKNALLECADKLESQNEEGKSVFDETCDLFASLKNQNLSGIYINRKDINAVSRILTGDWSWLQSRMNAYAKEKFTTKAEKARWQKSLDDEGENKSKGFYSLAELNELLEYVSENVAETNIRISDYFDHRCRYYVDKETEKFVQGSELVALSIKEMCDSILAKRKSMNGVLENLSDEKLLQEKPEDVAVIKDYLDAVQELLHRIKPLKVNGVGDAAFYSVFDSIYSALSEVISVYNKTRNYITKKAASPEKYKLNFESPTCANGWALNRELMYGCILLRKQDKYYLGIMNKDEHKFFKKYPLAKPRDDFFEKMIYLQAADPSKDVPNLMVINGKTVKKNGRKDSDGVNRQLEELRNTYLPENINKIRKSKSYLKSSETFSKEDLTEYIEYYKERAIDYFNSYKFFFKNSADYTSFVEFTDDINAQAYQIQFVKITTSFITQMVNGGKLFLFQIYNKDFSEKSNGKKNLHTLYFENLFSEENLKNTVLKLSAGAELFYRPAGIKEPTVHAKGSYLVNRTTEDGEAIPENIYLEIYKNANGKLESLSDEAKAYKESHKVVIKKAGHEIIKDRHYTEPKFLFHVPLTINFKASGNSYSINENVRRFLKNNPDVNIIGLDRGERHLIYLSLINQKGEIIKQFTFNDVEREQNGQIVKVNYHEKLDQREKVRDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGMLFYVPAGYTSKIDPKTGFVSMMNFKDLTNVHKKRDFFAKFDDIHFDNATGSFVFTFDYKNFDGKAKEEMKQTKWSVYSRDKRIVYFSKTKSYEDIMPTEKLRALFESAGIEYKSSNDILDSIMAVGADLKDGAKPSREIADFWDGLLYNFKLILQMRNSNAKTSEDYIISPVMASDGTFFDSREEFDKGKDAKLPLDADANGAYHIALKGLSLIKKINLSKDAELKKFDMKISNADWFKFVQQKEYTK

SEQ ID NO: 678 - protein, 1346 aa, synthetic construct
METIDSFCGQKNGYSISKTLRFELKPVGQTLESIKNGKFLESDKKKADDYQDVKKIIDNYHNFFIDDVLKSASFDWRQLEKSIHEYNKNKTDDSEFVKEQDKLRKGIADLFSKDKRYKSLTASTPSDLFNKDKDFIDWLAQTSVKEIRKDALETFKRFSSYFTGFQENRKNVYKSDLIPTAVPYRIVNDNFPKFLQNISIFKTIQKKCPQVIDDVENELCRYLGQEKLSDIFRLESFNKFLGQSGKEVQRGIDFYNQIIGGIAEKEGGVNLRGINQFLNLYWQQHPDFAKENRRVKMVPLYKQILSDRSSLSFKIESIANDEELKNALLECADKLESQNEEGKSVFDETCDLFASLKNQNLSGIYINRKDINAVSRILTGDWSWLQSRMNAYAKEKFTTKAEKARWQKSLDDEGENKSKGFYSLAELNELLEYVSENVAETNIRISDYFDHRCRYYVDKETEKFVQGSELVALSIKEMCDSILAKRKSMNGVLENLSDEKLLQEKPEDVAVIKDYLDAVQELLHRIKPLKVNGVGDAAFYSVFDSIYSALSEVISVYNKTRNYITKKAASPEKYKLNFESPTCARGWALNRELMYGCILLRKQDKYYLGIMNKDEHKFFKKYPLAKPRDDFFEKMIYLQAADPSKDVPNLMVINGKTVKKNGRKDSDGVNRQLEELRNTYLPENINKIRKSKSYLKSSETFSKEDLTEYIEYYKERAIDYFNSYKFFFKNSADYTSFVEFTDDINAQAYQIQFVKITTSFITQMVNGGKLFLFQIYNKDFSEKSNGKKNLHTLYFENLFSEENLKNTVLKLSAGAELFYRPAGIKEPTVHAKGSYLVNRTTEDGEAIPENIYLEIYKNANGKLESLSDEAKAYKESHKVVIKKAGHEIIKDRHYTEPKFLFHVPLTINFKASGNSYSINENVRRFLKNNPDVNIIGLDRGERHLIYLSLINQKGEIIKQFTFNDVEREQNGQIVKVNYHEKLDQREKVRDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGMLFYVPAGYTSKIDPKTGFVSMMNFKDLTNVHKKRDFFAKFDDIHFDNATGSFVFTFDYKNFDGKAKEEMKQTKWSVYSRDKRIVYFSKTKSYEDIMPTEKLRALFESAGIEYKSSNDILDSIMAVGADLKDGAKPSREIADFWDGLLYNFKLILQMRNSNAKTSEDYIISPVMASDGTFFDSREEFDKGKDAKLPLDADANGAYHIALKGLSLIKKINLSKDAELKKFDMKISNADWFKFVQQKEYTK

SEQ ID NO: 679 - protein, 1346 aa, synthetic construct
METIDSFCGQKNGYSISKTLRFELKPVGQTLESIKNGKFLESDKKKADDYQDVKKIIDNYHNFFIDDVLKSASFDWRQLEKSIHEYNKNKTDDSEFVKEQDKLRKGIADLFSKDKRYKSLTASTPSDLFNKDKDFIDWLAQTSVKEIRKDALETFKRFSSYFTGFQRNRKNVYKSDLIPTAVPYRIVNDNFPKFLQNISIFKTIQKKCPQVIDDVENELCRYLGQEKLSDIFRLESFNKFLGQSGKEVQRGIDFYNQIIGGIAEKEGGVNLRGINQFLNLYWQQHPDFAKENRRVKMVPLYKQILSDRSSLSFKIESIANDEELKNALLECADKLESQNEEGKSVFDETCDLFASLKNQNLSGIYINRKDINAVSRILTGDWSWLQSRMNAYAKEKFTTKAEKARWQKSLDDEGENKSKGFYSLAELNELLEYVSENVAETNIRISDYFDHRCRYYVDKETEKFVQGSELVALSIKEMCDSILAKRKSMNGVLENLSDEKLLQEKPEDVAVIKDYLDAVQELLHRIKPLKVNGVGDAAFYSVFDSIYSALSEVISVYNKTRNYITKKAASPEKYKLNFESPTCARGWALNRELMYGCILLRKQDKYYLGIMNKDEHKFFKKYPLAKPRDDFFEKMIYLQAADPSKDVPNLMVINGKTVKKNGRKDSDGVNRQLEELRNTYLPENINKIRKSKSYLKSSETFSKEDLTEYIEYYKERAIDYFNSYKFFFKNSADYTSFVEFTDDINAQAYQIQFVKITTSFITQMVNGGKLFLFQIYNKDFSEKSNGKKNLHTLYFENLFSEENLKNTVLKLSAGAELFYRPAGIKEPTVHAKGSYLVNRTTEDGEAIPENIYLEIYKNANGKLESLSDEAKAYKESHKVVIKKAGHEIIKDRHYTEPKFLFHVPLTINFKASGNSYSINENVRRFLKNNPDVNIIGLDRGERHLIYLSLINQKGEIIKQFTFNDVEREQNGQIVKVNYHEKLDQREKVRDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGMLFYVPAGYTSKIDPKTGFVSMMNFKDLTNVHKKRDFFAKFDDIHFDNATGSFVFTFDYKNFDGKAKEEMKQTKWSVYSRDKRIVYFSKTKSYEDIMPTEKLRALFESAGIEYKSSNDILDSIMAVGADLKDGAKPSREIADFWDGLLYNFKLILQMRNSNAKTSEDYIISPVMASDGTFFDSREEFDKGKDAKLPLDADANGAYHIALKGLSLIKKINLSKDAELKKFDMKISNADWFKFVQQKEYTK

SEQ ID NO: 680 - protein, 1346 aa, synthetic construct
METIDSFCGQKNGYSISKTLRFELKPVGQTLESIKNGKFLESDKKKADDYQDVKKIIDNYHNFFIDDVLKSASFDWRQLEKSIHEYNKNKTDDSEFVKEQDKLRKGIADLFSKDKRYKSLTASTPSDLFNKDKDFIDWLAQTSVKEIRKDALETFKRFSSYFTGFQRNRKNVYKSDLIPTAVPYRIVNDNFPKFLQNISIFKTIQKKCPQVIDDVENELCRYLGQEKLSDIFRLESFNKFLGQSGKEVQRGIDFYNQIIGGIAEKEGGVNLRGINQFLALYWQQHPDFAKENRRVKMVPLYKQILSDRSSLSFKIESIANDEELKNALLECADKLESQNEEGKSVFDETCDLFASLKNQNLSGIYINRKDINAVSRILTGDWSWLQSRMNAYAKEKFTTKAEKARWQKSLDDEGENKSKGFYSLAELNELLEYVSENVAETNIRISDYFDHRCRYYVDKETEKFVQGSELVALSIKEMCDSILAKRKSMNGVLENLSDEKLLQEKPEDVAVIKDYLDAVQELLHRIKPLKVNGVGDAAFYSVFDSIYSALSEVISVYNKTRNYITKKAASPEKYKLNFESPTCANGWALNRELMYGCILLRKQDKYYLGIMNKDEHKFFKKYPLAKPRDDFFEKMIYLQAADPSKDVPNLMVINGKTVKKNGRKDSDGVNRQLEELRNTYLPENINKIRKSKSYLKSSETFSKEDLTEYIEYYKERAIDYFNSYKFFFKNSADYTSFVEFTDDINAQAYQIQFVKITTSFITQMVNGGKLFLFQIYNKDFSEKSNGKKNLHTLYFENLFSEENLKNTVLKLSAGAELFYRPAGIKEPTVHAKGSYLVNRTTEDGEAIPENIYLEIYKNANGKLESLSDEAKAYKESHKVVIKKAGHEIIKDRHYTEPKFLFHVPLTINFKASGNSYSINENVRRFLKNNPDVNIIGLDRGERHLIYLSLINQKGEIIKQFTFNDVEREQNGQIVKVNYHEKLDQREKVRDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGMLFYVPAGYTSKIDPKTGFVSMMNFKDLTNVHKKRDFFAKFDDIHFDNATGSFVFTFDYKNFDGKAKEEMKQTKWSVYSRDKRIVYFSKTKSYEDIMPTEKLRALFESAGIEYKSSNDILDSIMAVGADLKDGAKPSREIADFWDGLLYNFKLILQMRNSNAKTSEDYIISPVMASDGTFFDSREEFDKGKDAKLPLDADANGAYHIALKGLSLIKKINLSKDAELKKFDMKISNADWFKFVQQKEYTK

SEQ ID NO: 681 - protein, 1346 aa, synthetic construct
METIDSFCGQKNGYSISKTLRFELKPVGQTLESIKNGKFLESDKKKADDYQDVKKIIDNYHNFFIDDVLKSASFDWRQLEKSIHEYNKNKTDDSEFVKEQDKLRKGIADLFSKDKRYKSLTASTPSDLFNKDKDFIDWLAQTSVKEIRKDALETFKRFSSYFTGFQENRKNVYKSDLIPTAVPYRIVNDNFPKFLQNISIFKTIQKKCPQVIDDVENELCRYLGQEKLSDIFRLESFNKFLGQSGKEVQRGIDFYNQIIGGIAEKEGGVNLRGINQFLNLYWQQHPDFAKENRRVKMVPLYKQILSDRSSLSFKIESIANDEELKNALLECADKLESQNEEGKSVFDETCDLFASLKNQNLSGIYINRKDINAVSRILTGDWSWLQSRMNAYAKEKFTTKAEKARWQKSLDDEGENKSKGFYSLAELNELLEYVSENVAETNIRISDYFDHRCRYYVDKETEKFVQGSELVALSIKEMCDSILAKRKSMNGVLENLSDEKLLQEKPEDVAVIKDYLDAVQELLHRIKPLKVNGVGDAAFYSVFDSIYSALSEVISVYNKTRNYITKKAASPEKYKLNFERPTCANGWALNNELMYGCILLRKQDKYYLGIMNKDEHKFFKKYPLAKPRDDFFEKMIYLQAADPSKDVPNLMVINGKTVKKNGRKDSDGVNRQLEELRNTYLPENINKIRKSKSYLKSSETFSKEDLTEYIEYYKERAIDYFNSYKFFFKNSADYTSFVEFTDDINAQAYQIQFVKITTSFITQMVNGGKLFLFQIYNKDFSEKSNGKKNLHTLYFENLFSEENLKNTVLKLSAGAELFYRPAGIKEPTVHAKGSYLVNRTTEDGEAIPENIYLEIYKNANGKLESLSDEAKAYKESHKVVIKKAGHEIIKDRHYTEPKFLFHVPLTINFKASGNSYSINENVRRFLKNNPDVNIIGLDRGERHLIYLSLINQKGEIIKQFTFNDVEREQNGQIVKVNYHEKLDQREKVRDAARKSWQAIGKIAELKEGYLSAVIHQLTKLMVEYNAIVVMEDLNFGFKRGRFHVEKQVYQKFEHMLIDKLNYLVFKDRGLNEPGGVLNGYQLAGQFESFQKLGKQSGMLFYVPAGYTSKIDPKTGFVSMMNFKDLTNVHKKRDFFAKFDDIHFDNATGSFVFTFDYKNFDGKAKEEMKQTKWSVYSRDKRIVYFSKTKSYEDIMPTEKLRALFESAGIEYKSSNDILDSIMAVGADLKDGAKPSREIADFWDGLLYNFKLILQMRNSNAKTSEDYIISPVMASDGTFFDSREEFDKGKDAKLPLDADANGAYHIALKGLSLIKKINLSKDAELKKFDMKISNADWFKFVQQKEYTK

SEQ ID NO: 682 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNRNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNCPTLLNGWNLNKEKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFQFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 683 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNQNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNCPTLLRGWNLNKEKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFQFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 684 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNQNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNCPTLLNGWNLNREKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFQFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 685 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNRNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNCPTLLRGWNLNKEKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFQFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 686 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNRNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNCPTLLNGWNLNREKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFQFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 687 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNQNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNCPTLLRGWNLNREKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFQFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 688 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNRNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNCPTLLRGWNLNREKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFQFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 689 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNRNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYIAEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNCPTLLNGWNLNREKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFQFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 690 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNQNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNRPTLLNGWNLNKEKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFQFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 691 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNQNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNCPTLLNGWNLNKEKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFLFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 692 - protein, 1208 aa, synthetic construct
MKQFHNLYQLSKTLRFELVPQCNTENLITEMINADKNKADAYKKVKLFLDELHKDVIAEALENFQLSENDLIAAYEVFGNKAKKENFENHQEKLYTAVKNHTERIYKQKGLSEGKKIIALLKEKLQSDENAMCLLNEFDRFTTYSVGYNQNRENMYTEQIPNRLIIDNLPKHYQNIHIYEKIRDKLADKLRRLSQDFQVDTDQLFSIDDFNNRLTQSGIDCYNEVIGGRSEKEGQKTKGLNEYINEYNMNHKTEKLPRFKQLYKQILSDSDSNSFKYSEIDSIEELTQEIDDYCSELDQNVLKTKALFELFQDFASDHYDLSKVYIAVPYVNSVSHFAFGPWDYIKLAMKDKFSEDKTMEKTIELLENPIDNKNKKRRFISLEILQQALSKDDFIKLTEYFAQMKSPKKNRDPKNSDELKRSLNLFESINNAYARYSQNKEDISTIKRLLDAVKDLQNFVRVFITDDTVETDATFYNVLNEQYASLRKIISLYNKARNFSTKKPYSLEKFKLNFNRPTLLNGWNLNKEKDNLSILLRKDGIYYLGIVNSKHKKEAFETLEKESPETEKEFYEKMDYKLLPGANKMLPKVFLSRKGIEKFHPSADMLEKYENGCHKKGDSFDINFCHELIDFFKSSINKHEDWKKFNFHFSPTESYEDISEFYKEIAAQGYKLTFRSVAVDNIHKLVKEGKLYLFKIYNKDFSRYSHGTPNLHTMYWRALFDEDNLKNVVYKLNGEAEIFFRKKSIEKDRIVKHKANKPIPQRRIKNKFSMFNFDLIKDKRFTADKFLFHVPITLNFQAEGKKNINDLVKDYIKNSNDISVIGIDRGERNLLYYSLIDSKGNIKEQGSLNVIGEKFKTDYHYLLDEREKERTMAREEWQEIGKIKDLKTGYLSQVVHKITELAVQHNAIVVLENLNNGFKNSRKKIEKQVYQKFEKMLIEKLNYLVIKSKKEKTEEGGILNAYQLTSAFESFEKLGTQSGFLFYIPPWNTSNIDPATGFVKFFRTVYQNIEKTKEFISKFKEIRYNERDGYFEFEVDDCEKFIDKSDKKNRSASKPELNKKDWVICTYGDRIVREKTDNQWITKEEYNITSEFRKLFEQYQIRQDHIKEDITNLTEANFFKRFLQLFGYTVQLRNSNDKDDYILSPVKNKNGEFFDSRKSDRSLFPIDADANGAYNIARKGLMVIDKIKNNQKITISEKEWLNFAQNNN

SEQ ID NO: 693 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNRNRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFENSTLLDGWDVNKETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFFFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 694 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNENRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFENSTLLRGWDVNKETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFFFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 695 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNENRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFENSTLLDGWDVNRETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFFFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 696 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNRNRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFENSTLLRGWDVNKETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFFFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 697 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNRNRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFENSTLLDGWDVNRETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFFFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 698 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNENRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFENSTLLRGWDVNRETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFFFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 699 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNRNRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFENSTLLRGWDVNRETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFFFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 700 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNRNRNNLYVKDANSTAIAYRIIHENMEKHFANCLRFVQIQGKYPELANGLSVFGENFTPPSFLNYLGQSGIDRYNETIGHKSDDINAKGVNQLIAEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFENSTLLDGWDVNRETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFFFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 701 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNENRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFERSTLLDGWDVNKETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFFFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 702 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNENRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFENSTLLDGWDVNKETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFLFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 703 - protein, 1299 aa, synthetic construct
MAENRKLSDFCGKYSLSKTLRFELRPVGETADHIEDFKNQALKQIVAQDKKRADDYQQIKKILDNYHRHFIESVLAEPILTAEDQKNAKGKVEKYGINSAFEAYVTAKNKNATKDEKKTYQTIQDNLRKIIAEEFSLRSKDFYIYKGEFSKLINKVGSGNNKTEGRLWHWLRSGLDNEEITQEEFDSACEYIANFDKFTTYFTGFNENRNNLYVKDANSTAIAYRIIHENMEKHFANCLRFVQIQGKYPELANGLSVFGENFTPPSFLNYLGQSGIDRYNETIGHKSDDINAKGVNQLINEYRQKNKLKARELPFMTVLYKQILSDRASGFIIDEFNDGKSVFEAIKAFHAEITDSDIITELQNCLAEFLILENQDSIYIKNDLSLTGISNKLWGDWSYIKQAISNCCRDKLGKTENQIETIIKQDYYPLGFVQQTLDYYCEAIDKPENQKDLLQYFNTFSQDEKLLTDIFQQAYHEAKATLELDDFDNDRRTPGKDLPDGGKGFIQIEKIKQYLDSVLAIGHFVKPLYMIKSGKMIQLEEKNTDFYDAFNALYDQLANAITLYNKVRNYVTKKPYKTDKFKINFERSTLLDGWDVNKETANTSVLLLRNGKYYLGIMPKNANNIFNYKPESSDSENKTQTKINLQQQILADIADDYFEKMVYKLLPDPSRMLPKVFFATSNIEIYNPSQEVKDIRKLGLFKKDAANPEAMHKWVDFMKESLKKHPEWNEYFNFNFLRTSQYPDVSRFYKDVADQGYCLSFDKIKTSYIEEQIASGNLYLFEIYSKDFSPYSKGRPNLHTSYWKLLFSKENLSDVVLKLNGQAEIFFRPASLKRTEVVIHPANKPVRNKNPLNAKKQSIFDYDIIKDRRFTQDKFLFHCPITINFKQGGFGKFNDGVNAYLAGNPDINMIGIDRGERHLLYYSVIDQNSNIIEQGSLNTIANSLTSNGKEVQKQTDYHSLLDDKEKQRDVARKTWSAVENIKELKAGYLSHVVHKLATLMIKHNAVVCLEDLNFGFKRGRIKVEKQVYQKFEKSLIDKLNYLVFKDKDFGQAGHYLGGYQLTAPFESFQKLGKQSGFLFYVTSDYTSKIDPVTGFVSRINSRYESVAKSQELFNKFDSISYNYQKNYFEFYLDYAKFRNGDSGKWKACTHGNQRYRYNKADMDYKCYDVTAELKTLFDKAGIDYASGNNLKDTIVNQQDKTFFSSLLFYLSLTLQLRHTYKSNGIEKDFILSPVANDEGIFFDSRQYETMNNSPLPIDADANGAYNIARKGLLTLKQINTAGKPSAIKNSEWFDFVQNK

SEQ ID NO: 704 - protein, 1300 aa, synthetic construct
MKMNEEFCGQKNGYSRSITLRNKLIPIGKTEENINQFLENDIERSMAYPEVKKLIDDIHRSFIQDTLSKVTFPWEPLFDEFELYQNEKDKLKKASHKKELEKLQTVARKRIVEAFKKNPDFDKLFKDGLFKELLPALIKNSTDKEITDKKEAVEVFNRFSTYFTGFHRNRQNMYSEDPKSTAISYRIVNENFPKFFANVKLFNYLQENFPQIIKDTETSLKLHLNGKTLSQIFNIEAFNDVLTQTGIDFYNTVIGGISGEAGSEKVQGLNEKINLAKQQLPKEEQNKLRGKMTVLYKQILSDRETSSFIPVGFENNNEVYDTVKQFNDETYSNVVEKIKELINICSDYDISQIFVPAKELTAFSLSIFGNWSILSEGLFLLEKDKSTKNLTEKQIEAINKEIEKKDYSLVELQTAYERWCTENTIPVTKTVRNFFAIKPLKNQKDSPDKTESDILQNIKSKYAIIDFENQHDLQQEKDAATPIKDYLDEVQELYHHLKLVDYRGEEQKDTNFYSKLDEVLQKLSEIVPLYNKVRNYVTKKPGEVKKVKLNFDCSSFLNGWGTEFGTKDTHLFIIDGKYYLGIIDKKLSKDEITGLQNTVNNSCKHIIYDFQKPDNKNTPRLFIRSKGESYAPAVSKYNLPIESIIDIYDKGMFKTEYRDKNPQEYRKALIQIIEYFKLGFSKHESYKNYDFCWKEADEYNDIAEFYSDVIKSCYKLDFENINYEKLLSLVDSGKLFLFQIYNKDFAEKSSGKKNLHTLYWENLFSEENLKDICLKLNGEAELFWRKASLDSEKVTHHKKGSILVNRTTKDGKSIPEEIYQEIYQYKNKMISSVSDETKKLLDSGTVVFKEATHEITKDKHFTEDTYLFHCPITMNFKAPEITGRKFNDKVLEYLSKNPDVKIIGLDRGERHLLYLSLINQKGEIEMQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKGVTEPGGVLNAYQLTDKSANVSDVYKQCGWLFYIPAAYTSKIDPKTGFSNLFITKGLTNVEKKKEFFDKFDSIRYDNKEDCFVFGFDYSKLCDNADYNKKWEVYTKGERLVYSKAERTNITVNPTAELKKVFEEFNINWKSEDNFIDSLQTIQAEKTNIKFFDTLLRSFNATLQMRNSIPNSEIDYLISPVKADDGTFFDSREQLALGKEAKLPIDADANGAYHIALKGLYLLQNDFNRNEKGVIQNISNADWFRFVQEKEYQK

SEQ ID NO: 705 - protein, 1300 aa, synthetic construct
MKMNEEFCGQKNGYSRSITLRNKLIPIGKTEENINQFLENDIERSMAYPEVKKLIDDIHRSFIQDTLSKVTFPWEPLFDEFELYQNEKDKLKKASHKKELEKLQTVARKRIVEAFKKNPDFDKLFKDGLFKELLPALIKNSTDKEITDKKEAVEVFNRFSTYFTGFHQNRQNMYSEDPKSTAISYRIVNENFPKFFANVKLFNYLQENFPQIIKDTETSLKLHLNGKTLSQIFNIEAFNDVLTQTGIDFYNTVIGGISGEAGSEKVQGLNEKINLAKQQLPKEEQNKLRGKMTVLYKQILSDRETSSFIPVGFENNNEVYDTVKQFNDETYSNVVEKIKELINICSDYDISQIFVPAKELTAFSLSIFGNWSILSEGLFLLEKDKSTKNLTEKQIEAINKEIEKKDYSLVELQTAYERWCTENTIPVTKTVRNFFAIKPLKNQKDSPDKTESDILQNIKSKYAIIDFENQHDLQQEKDAATPIKDYLDEVQELYHHLKLVDYRGEEQKDTNFYSKLDEVLQKLSEIVPLYNKVRNYVTKKPGEVKKVKLNFDCSSFLRGWGTEFGTKDTHLFIIDGKYYLGIIDKKLSKDEITGLQNTVNNSCKHIIYDFQKPDNKNTPRLFIRSKGESYAPAVSKYNLPIESIIDIYDKGMFKTEYRDKNPQEYRKALIQIIEYFKLGFSKHESYKNYDFCWKEADEYNDIAEFYSDVIKSCYKLDFENINYEKLLSLVDSGKLFLFQIYNKDFAEKSSGKKNLHTLYWENLFSEENLKDICLKLNGEAELFWRKASLDSEKVTHHKKGSILVNRTTKDGKSIPEEIYQEIYQYKNKMISSVSDETKKLLDSGTVVFKEATHEITKDKHFTEDTYLFHCPITMNFKAPEITGRKFNDKVLEYLSKNPDVKIIGLDRGERHLLYLSLINQKGEIEMQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKGVTEPGGVLNAYQLTDKSANVSDVYKQCGWLFYIPAAYTSKIDPKTGFSNLFITKGLTNVEKKKEFFDKFDSIRYDNKEDCFVFGFDYSKLCDNADYNKKWEVYTKGERLVYSKAERTNITVNPTAELKKVFEEFNINWKSEDNFIDSLQTIQAEKTNIKFFDTLLRSFNATLQMRNSIPNSEIDYLISPVKADDGTFFDSREQLALGKEAKLPIDADANGAYHIALKGLYLLQNDFNRNEKGVIQNISNADWFRFVQEKEYQK

SEQ ID NO: 706 - protein, 1300 aa, synthetic construct
MKMNEEFCGQKNGYSRSITLRNKLIPIGKTEENINQFLENDIERSMAYPEVKKLIDDIHRSFIQDTLSKVTFPWEPLFDEFELYQNEKDKLKKASHKKELEKLQTVARKRIVEAFKKNPDFDKLFKDGLFKELLPALIKNSTDKEITDKKEAVEVFNRFSTYFTGFHQNRQNMYSEDPKSTAISYRIVNENFPKFFANVKLFNYLQENFPQIIKDTETSLKLHLNGKTLSQIFNIEAFNDVLTQTGIDFYNTVIGGISGEAGSEKVQGLNEKINLAKQQLPKEEQNKLRGKMTVLYKQILSDRETSSFIPVGFENNNEVYDTVKQFNDETYSNVVEKIKELINICSDYDISQIFVPAKELTAFSLSIFGNWSILSEGLFLLEKDKSTKNLTEKQIEAINKEIEKKDYSLVELQTAYERWCTENTIPVTKTVRNFFAIKPLKNQKDSPDKTESDILQNIKSKYAIIDFENQHDLQQEKDAATPIKDYLDEVQELYHHLKLVDYRGEEQKDTNFYSKLDEVLQKLSEIVPLYNKVRNYVTKKPGEVKKVKLNFDCSSFLNGWGTERGTKDTHLFIIDGKYYLGIIDKKLSKDEITGLQNTVNNSCKHIIYDFQKPDNKNTPRLFIRSKGESYAPAVSKYNLPIESIIDIYDKGMFKTEYRDKNPQEYRKALIQIIEYFKLGFSKHESYKNYDFCWKEADEYNDIAEFYSDVIKSCYKLDFENINYEKLLSLVDSGKLFLFQIYNKDFAEKSSGKKNLHTLYWENLFSEENLKDICLKLNGEAELFWRKASLDSEKVTHHKKGSILVNRTTKDGKSIPEEIYQEIYQYKNKMISSVSDETKKLLDSGTVVFKEATHEITKDKHFTEDTYLFHCPITMNFKAPEITGRKFNDKVLEYLSKNPDVKIIGLDRGERHLLYLSLINQKGEIEMQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKGVTEPGGVLNAYQLTDKSANVSDVYKQCGWLFYIPAAYTSKIDPKTGFSNLFITKGLTNVEKKKEFFDKFDSIRYDNKEDCFVFGFDYSKLCDNADYNKKWEVYTKGERLVYSKAERTNITVNPTAELKKVFEEFNINWKSEDNFIDSLQTIQAEKTNIKFFDTLLRSFNATLQMRNSIPNSEIDYLISPVKADDGTFFDSREQLALGKEAKLPIDADANGAYHIALKGLYLLQNDFNRNEKGVIQNISNADWFRFVQEKEYQK

SEQ ID NO: 707 - protein, 1300 aa, synthetic construct
MKMNEEFCGQKNGYSRSITLRNKLIPIGKTEENINQFLENDIERSMAYPEVKKLIDDIHRSFIQDTLSKVTFPWEPLFDEFELYQNEKDKLKKASHKKELEKLQTVARKRIVEAFKKNPDFDKLFKDGLFKELLPALIKNSTDKEITDKKEAVEVFNRFSTYFTGFHRNRQNMYSEDPKSTAISYRIVNENFPKFFANVKLFNYLQENFPQIIKDTETSLKLHLNGKTLSQIFNIEAFNDVLTQTGIDFYNTVIGGISGEAGSEKVQGLNEKINLAKQQLPKEEQNKLRGKMTVLYKQILSDRETSSFIPVGFENNNEVYDTVKQFNDETYSNVVEKIKELINICSDYDISQIFVPAKELTAFSLSIFGNWSILSEGLFLLEKDKSTKNLTEKQIEAINKEIEKKDYSLVELQTAYERWCTENTIPVTKTVRNFFAIKPLKNQKDSPDKTESDILQNIKSKYAIIDFENQHDLQQEKDAATPIKDYLDEVQELYHHLKLVDYRGEEQKDTNFYSKLDEVLQKLSEIVPLYNKVRNYVTKKPGEVKKVKLNFDCSSFLRGWGTEFGTKDTHLFIIDGKYYLGIIDKKLSKDEITGLQNTVNNSCKHIIYDFQKPDNKNTPRLFIRSKGESYAPAVSKYNLPIESIIDIYDKGMFKTEYRDKNPQEYRKALIQIIEYFKLGFSKHESYKNYDFCWKEADEYNDIAEFYSDVIKSCYKLDFENINYEKLLSLVDSGKLFLFQIYNKDFAEKSSGKKNLHTLYWENLFSEENLKDICLKLNGEAELFWRKASLDSEKVTHHKKGSILVNRTTKDGKSIPEEIYQEIYQYKNKMISSVSDETKKLLDSGTVVFKEATHEITKDKHFTEDTYLFHCPITMNFKAPEITGRKFNDKVLEYLSKNPDVKIIGLDRGERHLLYLSLINQKGEIEMQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKGVTEPGGVLNAYQLTDKSANVSDVYKQCGWLFYIPAAYTSKIDPKTGFSNLFITKGLTNVEKKKEFFDKFDSIRYDNKEDCFVFGFDYSKLCDNADYNKKWEVYTKGERLVYSKAERTNITVNPTAELKKVFEEFNINWKSEDNFIDSLQTIQAEKTNIKFFDTLLRSFNATLQMRNSIPNSEIDYLISPVKADDGTFFDSREQLALGKEAKLPIDADANGAYHIALKGLYLLQNDFNRNEKGVIQNISNADWFRFVQEKEYQK

SEQ ID NO: 708 - protein, 1300 aa, synthetic construct
MKMNEEFCGQKNGYSRSITLRNKLIPIGKTEENINQFLENDIERSMAYPEVKKLIDDIHRSFIQDTLSKVTFPWEPLFDEFELYQNEKDKLKKASHKKELEKLQTVARKRIVEAFKKNPDFDKLFKDGLFKELLPALIKNSTDKEITDKKEAVEVFNRFSTYFTGFHRNRQNMYSEDPKSTAISYRIVNENFPKFFANVKLFNYLQENFPQIIKDTETSLKLHLNGKTLSQIFNIEAFNDVLTQTGIDFYNTVIGGISGEAGSEKVQGLNEKINLAKQQLPKEEQNKLRGKMTVLYKQILSDRETSSFIPVGFENNNEVYDTVKQFNDETYSNVVEKIKELINICSDYDISQIFVPAKELTAFSLSIFGNWSILSEGLFLLEKDKSTKNLTEKQIEAINKEIEKKDYSLVELQTAYERWCTENTIPVTKTVRNFFAIKPLKNQKDSPDKTESDILQNIKSKYAIIDFENQHDLQQEKDAATPIKDYLDEVQELYHHLKLVDYRGEEQKDTNFYSKLDEVLQKLSEIVPLYNKVRNYVTKKPGEVKKVKLNFDCSSFLNGWGTERGTKDTHLFIIDGKYYLGIIDKKLSKDEITGLQNTVNNSCKHIIYDFQKPDNKNTPRLFIRSKGESYAPAVSKYNLPIESIIDIYDKGMFKTEYRDKNPQEYRKALIQIIEYFKLGFSKHESYKNYDFCWKEADEYNDIAEFYSDVIKSCYKLDFENINYEKLLSLVDSGKLFLFQIYNKDFAEKSSGKKNLHTLYWENLFSEENLKDICLKLNGEAELFWRKASLDSEKVTHHKKGSILVNRTTKDGKSIPEEIYQEIYQYKNKMISSVSDETKKLLDSGTVVFKEATHEITKDKHFTEDTYLFHCPITMNFKAPEITGRKFNDKVLEYLSKNPDVKIIGLDRGERHLLYLSLINQKGEIEMQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKGVTEPGGVLNAYQLTDKSANVSDVYKQCGWLFYIPAAYTSKIDPKTGFSNLFITKGLTNVEKKKEFFDKFDSIRYDNKEDCFVFGFDYSKLCDNADYNKKWEVYTKGERLVYSKAERTNITVNPTAELKKVFEEFNINWKSEDNFIDSLQTIQAEKTNIKFFDTLLRSFNATLQMRNSIPNSEIDYLISPVKADDGTFFDSREQLALGKEAKLPIDADANGAYHIALKGLYLLQNDFNRNEKGVIQNISNADWFRFVQEKEYQK

SEQ ID NO: 709 - protein, 1300 aa, synthetic construct
MKMNEEFCGQKNGYSRSITLRNKLIPIGKTEENINQFLENDIERSMAYPEVKKLIDDIHRSFIQDTLSKVTFPWEPLFDEFELYQNEKDKLKKASHKKELEKLQTVARKRIVEAFKKNPDFDKLFKDGLFKELLPALIKNSTDKEITDKKEAVEVFNRFSTYFTGFHQNRQNMYSEDPKSTAISYRIVNENFPKFFANVKLFNYLQENFPQIIKDTETSLKLHLNGKTLSQIFNIEAFNDVLTQTGIDFYNTVIGGISGEAGSEKVQGLNEKINLAKQQLPKEEQNKLRGKMTVLYKQILSDRETSSFIPVGFENNNEVYDTVKQFNDETYSNVVEKIKELINICSDYDISQIFVPAKELTAFSLSIFGNWSILSEGLFLLEKDKSTKNLTEKQIEAINKEIEKKDYSLVELQTAYERWCTENTIPVTKTVRNFFAIKPLKNQKDSPDKTESDILQNIKSKYAIIDFENQHDLQQEKDAATPIKDYLDEVQELYHHLKLVDYRGEEQKDTNFYSKLDEVLQKLSEIVPLYNKVRNYVTKKPGEVKKVKLNFDCSSFLRGWGTERGTKDTHLFIIDGKYYLGIIDKKLSKDEITGLQNTVNNSCKHIIYDFQKPDNKNTPRLFIRSKGESYAPAVSKYNLPIESIIDIYDKGMFKTEYRDKNPQEYRKALIQIIEYFKLGFSKHESYKNYDFCWKEADEYNDIAEFYSDVIKSCYKLDFENINYEKLLSLVDSGKLFLFQIYNKDFAEKSSGKKNLHTLYWENLFSEENLKDICLKLNGEAELFWRKASLDSEKVTHHKKGSILVNRTTKDGKSIPEEIYQEIYQYKNKMISSVSDETKKLLDSGTVVFKEATHEITKDKHFTEDTYLFHCPITMNFKAPEITGRKFNDKVLEYLSKNPDVKIIGLDRGERHLLYLSLINQKGEIEMQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKGVTEPGGVLNAYQLTDKSANVSDVYKQCGWLFYIPAAYTSKIDPKTGFSNLFITKGLTNVEKKKEFFDKFDSIRYDNKEDCFVFGFDYSKLCDNADYNKKWEVYTKGERLVYSKAERTNITVNPTAELKKVFEEFNINWKSEDNFIDSLQTIQAEKTNIKFFDTLLRSFNATLQMRNSIPNSEIDYLISPVKADDGTFFDSREQLALGKEAKLPIDADANGAYHIALKGLYLLQNDFNRNEKGVIQNISNADWFRFVQEKEYQK

SEQ ID NO: 710 - protein, 1300 aa, synthetic construct
MKMNEEFCGQKNGYSRSITLRNKLIPIGKTEENINQFLENDIERSMAYPEVKKLIDDIHRSFIQDTLSKVTFPWEPLFDEFELYQNEKDKLKKASHKKELEKLQTVARKRIVEAFKKNPDFDKLFKDGLFKELLPALIKNSTDKEITDKKEAVEVFNRFSTYFTGFHRNRQNMYSEDPKSTAISYRIVNENFPKFFANVKLFNYLQENFPQIIKDTETSLKLHLNGKTLSQIFNIEAFNDVLTQTGIDFYNTVIGGISGEAGSEKVQGLNEKINLAKQQLPKEEQNKLRGKMTVLYKQILSDRETSSFIPVGFENNNEVYDTVKQFNDETYSNVVEKIKELINICSDYDISQIFVPAKELTAFSLSIFGNWSILSEGLFLLEKDKSTKNLTEKQIEAINKEIEKKDYSLVELQTAYERWCTENTIPVTKTVRNFFAIKPLKNQKDSPDKTESDILQNIKSKYAIIDFENQHDLQQEKDAATPIKDYLDEVQELYHHLKLVDYRGEEQKDTNFYSKLDEVLQKLSEIVPLYNKVRNYVTKKPGEVKKVKLNFDCSSFLRGWGTERGTKDTHLFIIDGKYYLGIIDKKLSKDEITGLQNTVNNSCKHIIYDFQKPDNKNTPRLFIRSKGESYAPAVSKYNLPIESIIDIYDKGMFKTEYRDKNPQEYRKALIQIIEYFKLGFSKHESYKNYDFCWKEADEYNDIAEFYSDVIKSCYKLDFENINYEKLLSLVDSGKLFLFQIYNKDFAEKSSGKKNLHTLYWENLFSEENLKDICLKLNGEAELFWRKASLDSEKVTHHKKGSILVNRTTKDGKSIPEEIYQEIYQYKNKMISSVSDETKKLLDSGTVVFKEATHEITKDKHFTEDTYLFHCPITMNFKAPEITGRKFNDKVLEYLSKNPDVKIIGLDRGERHLLYLSLINQKGEIEMQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKGVTEPGGVLNAYQLTDKSANVSDVYKQCGWLFYIPAAYTSKIDPKTGFSNLFITKGLTNVEKKKEFFDKFDSIRYDNKEDCFVFGFDYSKLCDNADYNKKWEVYTKGERLVYSKAERTNITVNPTAELKKVFEEFNINWKSEDNFIDSLQTIQAEKTNIKFFDTLLRSFNATLQMRNSIPNSEIDYLISPVKADDGTFFDSREQLALGKEAKLPIDADANGAYHIALKGLYLLQNDFNRNEKGVIQNISNADWFRFVQEKEYQK

SEQ ID NO: 711 - protein, 1300 aa, synthetic construct
MKMNEEFCGQKNGYSRSITLRNKLIPIGKTEENINQFLENDIERSMAYPEVKKLIDDIHRSFIQDTLSKVTFPWEPLFDEFELYQNEKDKLKKASHKKELEKLQTVARKRIVEAFKKNPDFDKLFKDGLFKELLPALIKNSTDKEITDKKEAVEVFNRFSTYFTGFHRNRQNMYSEDPKSTAISYRIVNENFPKFFANVKLFNYLQENFPQIIKDTETSLKLHLNGKTLSQIFNIEAFNDVLTQTGIDFYNTVIGGISGEAGSEKVQGLNEKIALAKQQLPKEEQNKLRGKMTVLYKQILSDRETSSFIPVGFENNNEVYDTVKQFNDETYSNVVEKIKELINICSDYDISQIFVPAKELTAFSLSIFGNWSILSEGLFLLEKDKSTKNLTEKQIEAINKEIEKKDYSLVELQTAYERWCTENTIPVTKTVRNFFAIKPLKNQKDSPDKTESDILQNIKSKYAIIDFENQHDLQQEKDAATPIKDYLDEVQELYHHLKLVDYRGEEQKDTNFYSKLDEVLQKLSEIVPLYNKVRNYVTKKPGEVKKVKLNFDCSSFLNGWGTERGTKDTHLFIIDGKYYLGIIDKKLSKDEITGLQNTVNNSCKHIIYDFQKPDNKNTPRLFIRSKGESYAPAVSKYNLPIESIIDIYDKGMFKTEYRDKNPQEYRKALIQIIEYFKLGFSKHESYKNYDFCWKEADEYNDIAEFYSDVIKSCYKLDFENINYEKLLSLVDSGKLFLFQIYNKDFAEKSSGKKNLHTLYWENLFSEENLKDICLKLNGEAELFWRKASLDSEKVTHHKKGSILVNRTTKDGKSIPEEIYQEIYQYKNKMISSVSDETKKLLDSGTVVFKEATHEITKDKHFTEDTYLFHCPITMNFKAPEITGRKFNDKVLEYLSKNPDVKIIGLDRGERHLLYLSLINQKGEIEMQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKGVTEPGGVLNAYQLTDKSANVSDVYKQCGWLFYIPAAYTSKIDPKTGFSNLFITKGLTNVEKKKEFFDKFDSIRYDNKEDCFVFGFDYSKLCDNADYNKKWEVYTKGERLVYSKAERTNITVNPTAELKKVFEEFNINWKSEDNFIDSLQTIQAEKTNIKFFDTLLRSFNATLQMRNSIPNSEIDYLISPVKADDGTFFDSREQLALGKEAKLPIDADANGAYHIALKGLYLLQNDFNRNEKGVIQNISNADWFRFVQEKEYQK

SEQ ID NO: 712 - protein, 1300 aa, synthetic construct
MKMNEEFCGQKNGYSRSITLRNKLIPIGKTEENINQFLENDIERSMAYPEVKKLIDDIHRSFIQDTLSKVTFPWEPLFDEFELYQNEKDKLKKASHKKELEKLQTVARKRIVEAFKKNPDFDKLFKDGLFKELLPALIKNSTDKEITDKKEAVEVFNRFSTYFTGFHQNRQNMYSEDPKSTAISYRIVNENFPKFFANVKLFNYLQENFPQIIKDTETSLKLHLNGKTLSQIFNIEAFNDVLTQTGIDFYNTVIGGISGEAGSEKVQGLNEKINLAKQQLPKEEQNKLRGKMTVLYKQILSDRETSSFIPVGFENNNEVYDTVKQFNDETYSNVVEKIKELINICSDYDISQIFVPAKELTAFSLSIFGNWSILSEGLFLLEKDKSTKNLTEKQIEAINKEIEKKDYSLVELQTAYERWCTENTIPVTKTVRNFFAIKPLKNQKDSPDKTESDILQNIKSKYAIIDFENQHDLQQEKDAATPIKDYLDEVQELYHHLKLVDYRGEEQKDTNFYSKLDEVLQKLSEIVPLYNKVRNYVTKKPGEVKKVKLNFDRSSFLNGWGTEFGTKDTHLFIIDGKYYLGIIDKKLSKDEITGLQNTVNNSCKHIIYDFQKPDNKNTPRLFIRSKGESYAPAVSKYNLPIESIIDIYDKGMFKTEYRDKNPQEYRKALIQIIEYFKLGFSKHESYKNYDFCWKEADEYNDIAEFYSDVIKSCYKLDFENINYEKLLSLVDSGKLFLFQIYNKDFAEKSSGKKNLHTLYWENLFSEENLKDICLKLNGEAELFWRKASLDSEKVTHHKKGSILVNRTTKDGKSIPEEIYQEIYQYKNKMISSVSDETKKLLDSGTVVFKEATHEITKDKHFTEDTYLFHCPITMNFKAPEITGRKFNDKVLEYLSKNPDVKIIGLDRGERHLLYLSLINQKGEIEMQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKGVTEPGGVLNAYQLTDKSANVSDVYKQCGWLFYIPAAYTSKIDPKTGFSNLFITKGLTNVEKKKEFFDKFDSIRYDNKEDCFVFGFDYSKLCDNADYNKKWEVYTKGERLVYSKAERTNITVNPTAELKKVFEEFNINWKSEDNFIDSLQTIQAEKTNIKFFDTLLRSFNATLQMRNSIPNSEIDYLISPVKADDGTFFDSREQLALGKEAKLPIDADANGAYHIALKGLYLLQNDFNRNEKGVIQNISNADWFRFVQEKEYQK

SEQ ID NO: 713 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNRNRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLNGWVDSKTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 714 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNENRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLRGWVDSKTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 715 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNENRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLNGWVDSRTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 716 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNRNRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLRGWVDSKTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 717 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNRNRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLNGWVDSRTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 718 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNENRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLRGWVDSRTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 719 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNRNRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLRGWVDSRTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 720 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNRNRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVALYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLNGWVDSRTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 721 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNENRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFERNGSFLNGWVDSKTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFQFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 722 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNENRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFENNGSFLNGWVDSKTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFLFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 723 - protein, 1323 aa, synthetic construct
MNSIEQFTGLYSLSKTLRFELKPIGKTQENIEKNGILERDNERAVAYKSVKKYIDEYHKAFIERVMNSFPHNLSDEEQDIWEEALNNYYTSYHLPATNPQRKETLTEAQDTLRTLISNSFLRDRQYKRLFGKELFQEDLAEFVNTALFETYIRSQKGNNNLTEEEVRQIQENTIREISLFRNFTVYFSGYNENRKNMYVADDKATSIANRMITENLPKFVDNMEVFGKIAASEVANHFETLYKSMEAYLNVISIDEMFKLDYYPILLTQKQIDVYNTIIGGKVLEDGSKIQGLNEYVNLYNQQQKDKANRLPKLKPLFKQILSEHNAISWLPDTFSTDNEMLESIEKCYQNLRTQVFEGEISLKKLLDNLGDYDLEHIYIPNDLQLTNIVQKVYGDWSMVKKAMEEDVKAKNPQRKNETGEKYEERIVKILKSDESFSIAQINNLLKPYLGEKYVPLEKYFITKGAEDNNNVQKPNLFIRIENAYIEAKSLLNTQYPKDRTMSQDKQNVERIKILLDAIKDLQHFVKPLLGKGSEGQKDNTFYGEFIPLWEALDQITPLYNMVRNRMTQKPYSDDKIKLFFERNGSFLNGWVDSKTESDNATQYGGYLFRRKNSIGEYDYYLGISSATKLFRSFNHVSESDKSIFERLDYYQLKGKTFYGALYKGDYEKESSAIKLAIDKFITNNGNTIIREKINTEKRKRQPKVSTAIGYLKFLRQQGVELFDSLLKDGCFEESNQAMITSIKATLASMARIPNAQDYAHKDYSLFSDAMDDVEELLQDVIFSYFPISQKEMDKVLEREEKPMYLFKITNKDLSFAETHEKGLRKSRGTDNLHTMYFKALMSGTQNVFDIGSGTVFFRERKIVYSEEQLGKGHHHEMLKDKFDYPIISNKRYAYDKFLFHLSININYKADKHKDINLLVNEYLKESKVTHIIGIDRGERHLLYLSVIDLQGNIVEQYSLNEIVNEYNDCNYRTNYHDLLDIREKQRDEARRSWLTIESIKELKEGYMSQVVHLIAQLIVKYNAIVVLEDLNTGFIRGRQKVEKQVYQKFEKMLIDKLNYLVDKKKDIYDLGGALNALQLTNKFESFQKIGKQCGFLFYVPAWNTSKMDPTTGFVNMLDTRYENMDKAKAFFAKFRSIRQNVSKGWFEFAIDYNDFTSKAAGTKTQWTLCTYGTRIETKRDTKQNNNFVSDEFDLTDKFKVLFNKYNIDVNGNLMEQICSQNDATFFKELLHMLHLTLQMRNSITGTEVDYLISPVMNASGKFYDSRTCENNLPKNADANGAYNIARKGLWIVEQIKHSDNISKLKIAISNKEWLRYTQGLVD

SEQ ID NO: 724 - protein, 1309 aa, synthetic construct
MDAKKSIWDEMTNKYSLSKTLRFELKKPIGKTQEFIEKNGLIEEDEQRNKDFLCGKELLEGYYSDLIERRLGKIEIDSNLLEEYFKKYKEFNKLKQKGKEVDAKELKNSKDSLKASQRKLREELHKSFFDNDALFKDEEPFKEKRDNEDVIIAAVKFHRKKLLEKRNEGGVDNNLEIEEDKINCLYRFVNDHCTTYFTKFFRNRKNVFSDKAISTSIFYRTIHENLHFFVKNIENFEKLSEIIDEKELLEIEKELQKELGMFNLKEVFNINYFNNCLNQKGIDKYNQIISGVKKKDIQKEGLNNLINKLSQKKDKDQEERKNIRKLRMIQLYKQILSEPESKSFKIESIENGKELEENIFSFYKSIALPSENQKESVLTLLEKLFDSDELDFDGIYVKQKSINKISNKIHSDWYLIESALKERYKSKIKSTGKKDKTDLQKEKETKKWFKETKHFSINEINSAIEFTKNDLITKENKDIWKYFKGVKTKEKNLFNEIQTSFGDLKKVKFGKERELLYDDNEENVVKIKKALDYVQELFWLISPLMYEKPKEGVFDLDLNPDFYEKFVQIYEELQQITPLYNKTRNFISQKPHCESKFKLNFGDGYLLNGWAEKDGRCGYRAVIFRQGNKYYLGIIAKGKKNTKMFDKIPNYKSGDYYEKMKYNQLQKPDQNLPRIFFAPSNEKYYNPSEEIKSIKNKGSFRTNIEDCHKMIEFYKKSISKKSEWDIYKFKFKETNDYVSIDEFYKDFSNQAYKIEFQKISVDDIHELVDSGKLYLFTIYNKDFSEKKFKKDFSKRKPNLHTMYWKELFSDENLKNVVYQLNGGAEIFFRKKSPSNKKIIHIKNKAVPNEKPINGRKESTFEYDLIKDKRYFEDKYLFHCPITLNFKSEKNNVESFNNYINEFIVKNNDEINILGLDRGERNLLYYYLLNPNGEKIKSGSFNIFKDEFGREFDYHKMLSEREDERDKDQKEWKNIKNIKDLKEGYLSRIIHEISKIVIDNNAIVVLEDLNPDFKRNRFKFENQVYQKFEEKLIKKLNYLVFKNRKSTDSGGLFRAYQLTSKFVSFKNLREQKQSGILYYVNANYTSKIDPKTGFVNLLYPNYKNIEKSKLFFDKFDSIKYNKSENMFEFEFDYSNFTKNLKLKKNNWTVFTNGERIIQVKTKNNIYEPKKINLTNEMKNLFESEGISFNDGKNLKEEIINSNSKKLHTNLTNLLKYTLQLRNSNNKTGEDYILSCVKDDEKNFFNSNNAKDSEPENADANGAYHIGLKGIMLIKKMKKQSDKNQKIDLRISNEEYFNEMCSKEQSKKKES

SEQ ID NO: 725 - protein, 1309 aa, synthetic construct
MDAKKSIWDEMTNKYSLSKTLRFELKKPIGKTQEFIEKNGLIEEDEQRNKDFLCGKELLEGYYSDLIERRLGKIEIDSNLLEEYFKKYKEFNKLKQKGKEVDAKELKNSKDSLKASQRKLREELHKSFFDNDALFKDEEPFKEKRDNEDVIIAAVKFHRKKLLEKRNEGGVDNNLEIEEDKINCLYRFVNDHCTTYFTKFFNNRKNVFSDKAISTSIFYRTIHENLHFFVKNIENFEKLSEIIDEKELLEIEKELQKELGMFNLKEVFNINYFNNCLNQKGIDKYNQIISGVKKKDIQKEGLNNLINKLSQKKDKDQEERKNIRKLRMIQLYKQILSEPESKSFKIESIENGKELEENIFSFYKSIALPSENQKESVLTLLEKLFDSDELDFDGIYVKQKSINKISNKIHSDWYLIESALKERYKSKIKSTGKKDKTDLQKEKETKKWFKETKHFSINEINSAIEFTKNDLITKENKDIWKYFKGVKTKEKNLFNEIQTSFGDLKKVKFGKERELLYDDNEENVVKIKKALDYVQELFWLISPLMYEKPKEGVFDLDLNPDFYEKFVQIYEELQQITPLYNKTRNFISQKPHCESKFKLNFGDGYLLRGWAEKDGRCGYRAVIFRQGNKYYLGIIAKGKKNTKMFDKIPNYKSGDYYEKMKYNQLQKPDQNLPRIFFAPSNEKYYNPSEEIKSIKNKGSFRTNIEDCHKMIEFYKKSISKKSEWDIYKFKFKETNDYVSIDEFYKDFSNQAYKIEFQKISVDDIHELVDSGKLYLFTIYNKDFSEKKFKKDFSKRKPNLHTMYWKELFSDENLKNVVYQLNGGAEIFFRKKSPSNKKIIHIKNKAVPNEKPINGRKESTFEYDLIKDKRYFEDKYLFHCPITLNFKSEKNNVESFNNYINEFIVKNNDEINILGLDRGERNLLYYYLLNPNGEKIKSGSFNIFKDEFGREFDYHKMLSEREDERDKDQKEWKNIKNIKDLKEGYLSRIIHEISKIVIDNNAIVVLEDLNPDFKRNRFKFENQVYQKFEEKLIKKLNYLVFKNRKSTDSGGLFRAYQLTSKFVSFKNLREQKQSGILYYVNANYTSKIDPKTGFVNLLYPNYKNIEKSKLFFDKFDSIKYNKSENMFEFEFDYSNFTKNLKLKKNNWTVFTNGERIIQVKTKNNIYEPKKINLTNEMKNLFESEGISFNDGKNLKEEIINSNSKKLHTNLTNLLKYTLQLRNSNNKTGEDYILSCVKDDEKNFFNSNNAKDSEPENADANGAYHIGLKGIMLIKKMKKQSDKNQKIDLRISNEEYFNEMCSKEQSKKKES

SEQ ID NO: 726 - protein, 1309 aa, synthetic construct
MDAKKSIWDEMTNKYSLSKTLRFELKKPIGKTQEFIEKNGLIEEDEQRNKDFLCGKELLEGYYSDLIERRLGKIEIDSNLLEEYFKKYKEFNKLKQKGKEVDAKELKNSKDSLKASQRKLREELHKSFFDNDALFKDEEPFKEKRDNEDVIIAAVKFHRKKLLEKRNEGGVDNNLEIEEDKINCLYRFVNDHCTTYFTKFFNNRKNVFSDKAISTSIFYRTIHENLHFFVKNIENFEKLSEIIDEKELLEIEKELQKELGMFNLKEVFNINYFNNCLNQKGIDKYNQIISGVKKKDIQKEGLNNLINKLSQKKDKDQEERKNIRKLRMIQLYKQILSEPESKSFKIESIENGKELEENIFSFYKSIALPSENQKESVLTLLEKLFDSDELDFDGIYVKQKSINKISNKIHSDWYLIESALKERYKSKIKSTGKKDKTDLQKEKETKKWFKETKHFSINEINSAIEFTKNDLITKENKDIWKYFKGVKTKEKNLFNEIQTSFGDLKKVKFGKERELLYDDNEENVVKIKKALDYVQELFWLISPLMYEKPKEGVFDLDLNPDFYEKFVQIYEELQQITPLYNKTRNFISQKPHCESKFKLNFGDGYLLNGWAEKRGRCGYRAVIFRQGNKYYLGIIAKGKKNTKMFDKIPNYKSGDYYEKMKYNQLQKPDQNLPRIFFAPSNEKYYNPSEEIKSIKNKGSFRTNIEDCHKMIEFYKKSISKKSEWDIYKFKFKETNDYVSIDEFYKDFSNQAYKIEFQKISVDDIHELVDSGKLYLFTIYNKDFSEKKFKKDFSKRKPNLHTMYWKELFSDENLKNVVYQLNGGAEIFFRKKSPSNKKIIHIKNKAVPNEKPINGRKESTFEYDLIKDKRYFEDKYLFHCPITLNFKSEKNNVESFNNYINEFIVKNNDEINILGLDRGERNLLYYYLLNPNGEKIKSGSFNIFKDEFGREFDYHKMLSEREDERDKDQKEWKNIKNIKDLKEGYLSRIIHEISKIVIDNNAIVVLEDLNPDFKRNRFKFENQVYQKFEEKLIKKLNYLVFKNRKSTDSGGLFRAYQLTSKFVSFKNLREQKQSGILYYVNANYTSKIDPKTGFVNLLYPNYKNIEKSKLFFDKFDSIKYNKSENMFEFEFDYSNFTKNLKLKKNNWTVFTNGERIIQVKTKNNIYEPKKINLTNEMKNLFESEGISFNDGKNLKEEIINSNSKKLHTNLTNLLKYTLQLRNSNNKTGEDYILSCVKDDEKNFFNSNNAKDSEPENADANGAYHIGLKGIMLIKKMKKQSDKNQKIDLRISNEEYFNEMCSKEQSKKKES

SEQ ID NO: 727 - protein, 1309 aa, synthetic construct
MDAKKSIWDEMTNKYSLSKTLRFELKKPIGKTQEFIEKNGLIEEDEQRNKDFLCGKELLEGYYSDLIERRLGKIEIDSNLLEEYFKKYKEFNKLKQKGKEVDAKELKNSKDSLKASQRKLREELHKSFFDNDALFKDEEPFKEKRDNEDVIIAAVKFHRKKLLEKRNEGGVDNNLEIEEDKINCLYRFVNDHCTTYFTKFFRNRKNVFSDKAISTSIFYRTIHENLHFFVKNIENFEKLSEIIDEKELLEIEKELQKELGMFNLKEVFNINYFNNCLNQKGIDKYNQIISGVKKKDIQKEGLNNLINKLSQKKDKDQEERKNIRKLRMIQLYKQILSEPESKSFKIESIENGKELEENIFSFYKSIALPSENQKESVLTLLEKLFDSDELDFDGIYVKQKSINKISNKIHSDWYLIESALKERYKSKIKSTGKKDKTDLQKEKETKKWFKETKHFSINEINSAIEFTKNDLITKENKDIWKYFKGVKTKEKNLFNEIQTSFGDLKKVKFGKERELLYDDNEENVVKIKKALDYVQELFWLISPLMYEKPKEGVFDLDLNPDFYEKFVQIYEELQQITPLYNKTRNFISQKPHCESKFKLNFGDGYLLRGWAEKDGRCGYRAVIFRQGNKYYLGIIAKGKKNTKMFDKIPNYKSGDYYEKMKYNQLQKPDQNLPRIFFAPSNEKYYNPSEEIKSIKNKGSFRTNIEDCHKMIEFYKKSISKKSEWDIYKFKFKETNDYVSIDEFYKDFSNQAYKIEFQKISVDDIHELVDSGKLYLFTIYNKDFSEKKFKKDFSKRKPNLHTMYWKELFSDENLKNVVYQLNGGAEIFFRKKSPSNKKIIHIKNKAVPNEKPINGRKESTFEYDLIKDKRYFEDKYLFHCPITLNFKSEKNNVESFNNYINEFIVKNNDEINILGLDRGERNLLYYYLLNPNGEKIKSGSFNIFKDEFGREFDYHKMLSEREDERDKDQKEWKNIKNIKDLKEGYLSRIIHEISKIVIDNNAIVVLEDLNPDFKRNRFKFENQVYQKFEEKLIKKLNYLVFKNRKSTDSGGLFRAYQLTSKFVSFKNLREQKQSGILYYVNANYTSKIDPKTGFVNLLYPNYKNIEKSKLFFDKFDSIKYNKSENMFEFEFDYSNFTKNLKLKKNNWTVFTNGERIIQVKTKNNIYEPKKINLTNEMKNLFESEGISFNDGKNLKEEIINSNSKKLHTNLTNLLKYTLQLRNSNNKTGEDYILSCVKDDEKNFFNSNNAKDSEPENADANGAYHIGLKGIMLIKKMKKQSDKNQKIDLRISNEEYFNEMCSKEQSKKKES

SEQ ID NO: 728 - protein, 1309 aa, synthetic construct
MDAKKSIWDEMTNKYSLSKTLRFELKKPIGKTQEFIEKNGLIEEDEQRNKDFLCGKELLEGYYSDLIERRLGKIEIDSNLLEEYFKKYKEFNKLKQKGKEVDAKELKNSKDSLKASQRKLREELHKSFFDNDALFKDEEPFKEKRDNEDVIIAAVKFHRKKLLEKRNEGGVDNNLEIEEDKINCLYRFVNDHCTTYFTKFFRNRKNVFSDKAISTSIFYRTIHENLHFFVKNIENFEKLSEIIDEKELLEIEKELQKELGMFNLKEVFNINYFNNCLNQKGIDKYNQIISGVKKKDIQKEGLNNLINKLSQKKDKDQEERKNIRKLRMIQLYKQILSEPESKSFKIESIENGKELEENIFSFYKSIALPSENQKESVLTLLEKLFDSDELDFDGIYVKQKSINKISNKIHSDWYLIESALKERYKSKIKSTGKKDKTDLQKEKETKKWFKETKHFSINEINSAIEFTKNDLITKENKDIWKYFKGVKTKEKNLFNEIQTSFGDLKKVKFGKERELLYDDNEENVVKIKKALDYVQELFWLISPLMYEKPKEGVFDLDLNPDFYEKFVQIYEELQQITPLYNKTRNFISQKPHCESKFKLNFGDGYLLNGWAEKRGRCGYRAVIFRQGNKYYLGIIAKGKKNTKMFDKIPNYKSGDYYEKMKYNQLQKPDQNLPRIFFAPSNEKYYNPSEEIKSIKNKGSFRTNIEDCHKMIEFYKKSISKKSEWDIYKFKFKETNDYVSIDEFYKDFSNQAYKIEFQKISVDDIHELVDSGKLYLFTIYNKDFSEKKFKKDFSKRKPNLHTMYWKELFSDENLKNVVYQLNGGAEIFFRKKSPSNKKIIHIKNKAVPNEKPINGRKESTFEYDLIKDKRYFEDKYLFHCPITLNFKSEKNNVESFNNYINEFIVKNNDEINILGLDRGERNLLYYYLLNPNGEKIKSGSFNIFKDEFGREFDYHKMLSEREDERDKDQKEWKNIKNIKDLKEGYLSRIIHEISKIVIDNNAIVVLEDLNPDFKRNRFKFENQVYQKFEEKLIKKLNYLVFKNRKSTDSGGLFRAYQLTSKFVSFKNLREQKQSGILYYVNANYTSKIDPKTGFVNLLYPNYKNIEKSKLFFDKFDSIKYNKSENMFEFEFDYSNFTKNLKLKKNNWTVFTNGERIIQVKTKNNIYEPKKINLTNEMKNLFESEGISFNDGKNLKEEIINSNSKKLHTNLTNLLKYTLQLRNSNNKTGEDYILSCVKDDEKNFFNSNNAKDSEPENADANGAYHIGLKGIMLIKKMKKQSDKNQKIDLRISNEEYFNEMCSKEQSKKKES

SEQ ID NO: 729 - protein, 1309 aa, synthetic construct
MDAKKSIWDEMTNKYSLSKTLRFELKKPIGKTQEFIEKNGLIEEDEQRNKDFLCGKELLEGYYSDLIERRLGKIEIDSNLLEEYFKKYKEFNKLKQKGKEVDAKELKNSKDSLKASQRKLREELHKSFFDNDALFKDEEPFKEKRDNEDVIIAAVKFHRKKLLEKRNEGGVDNNLEIEEDKINCLYRFVNDHCTTYFTKFFNNRKNVFSDKAISTSIFYRTIHENLHFFVKNIENFEKLSEIIDEKELLEIEKELQKELGMFNLKEVFNINYFNNCLNQKGIDKYNQIISGVKKKDIQKEGLNNLINKLSQKKDKDQEERKNIRKLRMIQLYKQILSEPESKSFKIESIENGKELEENIFSFYKSIALPSENQKESVLTLLEKLFDSDELDFDGIYVKQKSINKISNKIHSDWYLIESALKERYKSKIKSTGKKDKTDLQKEKETKKWFKETKHFSINEINSAIEFTKNDLITKENKDIWKYFKGVKTKEKNLFNEIQTSFGDLKKVKFGKERELLYDDNEENVVKIKKALDYVQELFWLISPLMYEKPKEGVFDLDLNPDFYEKFVQIYEELQQITPLYNKTRNFISQKPHCESKFKLNFGDGYLLRGWAEKRGRCGYRAVIFRQGNKYYLGIIAKGKKNTKMFDKIPNYKSGDYYEKMKYNQLQKPDQNLPRIFFAPSNEKYYNPSEEIKSIKNKGSFRTNIEDCHKMIEFYKKSISKKSEWDIYKFKFKETNDYVSIDEFYKDFSNQAYKIEFQKISVDDIHELVDSGKLYLFTIYNKDFSEKKFKKDFSKRKPNLHTMYWKELFSDENLKNVVYQLNGGAEIFFRKKSPSNKKIIHIKNKAVPNEKPINGRKESTFEYDLIKDKRYFEDKYLFHCPITLNFKSEKNNVESFNNYINEFIVKNNDEINILGLDRGERNLLYYYLLNPNGEKIKSGSFNIFKDEFGREFDYHKMLSEREDERDKDQKEWKNIKNIKDLKEGYLSRIIHEISKIVIDNNAIVVLEDLNPDFKRNRFKFENQVYQKFEEKLIKKLNYLVFKNRKSTDSGGLFRAYQLTSKFVSFKNLREQKQSGILYYVNANYTSKIDPKTGFVNLLYPNYKNIEKSKLFFDKFDSIKYNKSENMFEFEFDYSNFTKNLKLKKNNWTVFTNGERIIQVKTKNNIYEPKKINLTNEMKNLFESEGISFNDGKNLKEEIINSNSKKLHTNLTNLLKYTLQLRNSNNKTGEDYILSCVKDDEKNFFNSNNAKDSEPENADANGAYHIGLKGIMLIKKMKKQSDKNQKIDLRISNEEYFNEMCSKEQSKKKES

SEQ ID NO: 730 - protein, 1309 aa, synthetic construct
MDAKKSIWDEMTNKYSLSKTLRFELKKPIGKTQEFIEKNGLIEEDEQRNKDFLCGKELLEGYYSDLIERRLGKIEIDSNLLEEYFKKYKEFNKLKQKGKEVDAKELKNSKDSLKASQRKLREELHKSFFDNDALFKDEEPFKEKRDNEDVIIAAVKFHRKKLLEKRNEGGVDNNLEIEEDKINCLYRFVNDHCTTYFTKFFRNRKNVFSDKAISTSIFYRTIHENLHFFVKNIENFEKLSEIIDEKELLEIEKELQKELGMFNLKEVFNINYFNNCLNQKGIDKYNQIISGVKKKDIQKEGLNNLINKLSQKKDKDQEERKNIRKLRMIQLYKQILSEPESKSFKIESIENGKELEENIFSFYKSIALPSENQKESVLTLLEKLFDSDELDFDGIYVKQKSINKISNKIHSDWYLIESALKERYKSKIKSTGKKDKTDLQKEKETKKWFKETKHFSINEINSAIEFTKNDLITKENKDIWKYFKGVKTKEKNLFNEIQTSFGDLKKVKFGKERELLYDDNEENVVKIKKALDYVQELFWLISPLMYEKPKEGVFDLDLNPDFYEKFVQIYEELQQITPLYNKTRNFISQKPHCESKFKLNFGDGYLLRGWAEKRGRCGYRAVIFRQGNKYYLGIIAKGKKNTKMFDKIPNYKSGDYYEKMKYNQLQKPDQNLPRIFFAPSNEKYYNPSEEIKSIKNKGSFRTNIEDCHKMIEFYKKSISKKSEWDIYKFKFKETNDYVSIDEFYKDFSNQAYKIEFQKISVDDIHELVDSGKLYLFTIYNKDFSEKKFKKDFSKRKPNLHTMYWKELFSDENLKNVVYQLNGGAEIFFRKKSPSNKKIIHIKNKAVPNEKPINGRKESTFEYDLIKDKRYFEDKYLFHCPITLNFKSEKNNVESFNNYINEFIVKNNDEINILGLDRGERNLLYYYLLNPNGEKIKSGSFNIFKDEFGREFDYHKMLSEREDERDKDQKEWKNIKNIKDLKEGYLSRIIHEISKIVIDNNAIVVLEDLNPDFKRNRFKFENQVYQKFEEKLIKKLNYLVFKNRKSTDSGGLFRAYQLTSKFVSFKNLREQKQSGILYYVNANYTSKIDPKTGFVNLLYPNYKNIEKSKLFFDKFDSIKYNKSENMFEFEFDYSNFTKNLKLKKNNWTVFTNGERIIQVKTKNNIYEPKKINLTNEMKNLFESEGISFNDGKNLKEEIINSNSKKLHTNLTNLLKYTLQLRNSNNKTGEDYILSCVKDDEKNFFNSNNAKDSEPENADANGAYHIGLKGIMLIKKMKKQSDKNQKIDLRISNEEYFNEMCSKEQSKKKES

SEQ ID NO: 731 - protein, 1309 aa, synthetic construct
MDAKKSIWDEMTNKYSLSKTLRFELKKPIGKTQEFIEKNGLIEEDEQRNKDFLCGKELLEGYYSDLIERRLGKIEIDSNLLEEYFKKYKEFNKLKQKGKEVDAKELKNSKDSLKASQRKLREELHKSFFDNDALFKDEEPFKEKRDNEDVIIAAVKFHRKKLLEKRNEGGVDNNLEIEEDKINCLYRFVNDHCTTYFTKFFRNRKNVFSDKAISTSIFYRTIHENLHFFVKNIENFEKLSEIIDEKELLEIEKELQKELGMFNLKEVFNINYFNNCLNQKGIDKYNQIISGVKKKDIQKEGLNNLIAKLSQKKDKDQEERKNIRKLRMIQLYKQILSEPESKSFKIESIENGKELEENIFSFYKSIALPSENQKESVLTLLEKLFDSDELDFDGIYVKQKSINKISNKIHSDWYLIESALKERYKSKIKSTGKKDKTDLQKEKETKKWFKETKHFSINEINSAIEFTKNDLITKENKDIWKYFKGVKTKEKNLFNEIQTSFGDLKKVKFGKERELLYDDNEENVVKIKKALDYVQELFWLISPLMYEKPKEGVFDLDLNPDFYEKFVQIYEELQQITPLYNKTRNFISQKPHCESKFKLNFGDGYLLNGWAEKRGRCGYRAVIFRQGNKYYLGIIAKGKKNTKMFDKIPNYKSGDYYEKMKYNQLQKPDQNLPRIFFAPSNEKYYNPSEEIKSIKNKGSFRTNIEDCHKMIEFYKKSISKKSEWDIYKFKFKETNDYVSIDEFYKDFSNQAYKIEFQKISVDDIHELVDSGKLYLFTIYNKDFSEKKFKKDFSKRKPNLHTMYWKELFSDENLKNVVYQLNGGAEIFFRKKSPSNKKIIHIKNKAVPNEKPINGRKESTFEYDLIKDKRYFEDKYLFHCPITLNFKSEKNNVESFNNYINEFIVKNNDEINILGLDRGERNLLYYYLLNPNGEKIKSGSFNIFKDEFGREFDYHKMLSEREDERDKDQKEWKNIKNIKDLKEGYLSRIIHEISKIVIDNNAIVVLEDLNPDFKRNRFKFENQVYQKFEEKLIKKLNYLVFKNRKSTDSGGLFRAYQLTSKFVSFKNLREQKQSGILYYVNANYTSKIDPKTGFVNLLYPNYKNIEKSKLFFDKFDSIKYNKSENMFEFEFDYSNFTKNLKLKKNNWTVFTNGERIIQVKTKNNIYEPKKINLTNEMKNLFESEGISFNDGKNLKEEIINSNSKKLHTNLTNLLKYTLQLRNSNNKTGEDYILSCVKDDEKNFFNSNNAKDSEPENADANGAYHIGLKGIMLIKKMKKQSDKNQKIDLRISNEEYFNEMCSKEQSKKKES

SEQ ID NO: 732 - protein, 1309 aa, synthetic construct
MDAKKSIWDEMTNKYSLSKTLRFELKKPIGKTQEFIEKNGLIEEDEQRNKDFLCGKELLEGYYSDLIERRLGKIEIDSNLLEEYFKKYKEFNKLKQKGKEVDAKELKNSKDSLKASQRKLREELHKSFFDNDALFKDEEPFKEKRDNEDVIIAAVKFHRKKLLEKRNEGGVDNNLEIEEDKINCLYRFVNDHCTTYFTKFFNNRKNVFSDKAISTSIFYRTIHENLHFFVKNIENFEKLSEIIDEKELLEIEKELQKELGMFNLKEVFNINYFNNCLNQKGIDKYNQIISGVKKKDIQKEGLNNLINKLSQKKDKDQEERKNIRKLRMIQLYKQILSEPESKSFKIESIENGKELEENIFSFYKSIALPSENQKESVLTLLEKLFDSDELDFDGIYVKQKSINKISNKIHSDWYLIESALKERYKSKIKSTGKKDKTDLQKEKETKKWFKETKHFSINEINSAIEFTKNDLITKENKDIWKYFKGVKTKEKNLFNEIQTSFGDLKKVKFGKERELLYDDNEENVVKIKKALDYVQELFWLISPLMYEKPKEGVFDLDLNPDFYEKFVQIYEELQQITPLYNKTRNFISQKPHCESKFKLNFGRGYLLNGWAEKDGRCGYRAVIFRQGNKYYLGIIAKGKKNTKMFDKIPNYKSGDYYEKMKYNQLQKPDQNLPRIFFAPSNEKYYNPSEEIKSIKNKGSFRTNIEDCHKMIEFYKKSISKKSEWDIYKFKFKETNDYVSIDEFYKDFSNQAYKIEFQKISVDDIHELVDSGKLYLFTIYNKDFSEKKFKKDFSKRKPNLHTMYWKELFSDENLKNVVYQLNGGAEIFFRKKSPSNKKIIHIKNKAVPNEKPINGRKESTFEYDLIKDKRYFEDKYLFHCPITLNFKSEKNNVESFNNYINEFIVKNNDEINILGLDRGERNLLYYYLLNPNGEKIKSGSFNIFKDEFGREFDYHKMLSEREDERDKDQKEWKNIKNIKDLKEGYLSRIIHEISKIVIDNNAIVVLEDLNPDFKRNRFKFENQVYQKFEEKLIKKLNYLVFKNRKSTDSGGLFRAYQLTSKFVSFKNLREQKQSGILYYVNANYTSKIDPKTGFVNLLYPNYKNIEKSKLFFDKFDSIKYNKSENMFEFEFDYSNFTKNLKLKKNNWTVFTNGERIIQVKTKNNIYEPKKINLTNEMKNLFESEGISFNDGKNLKEEIINSNSKKLHTNLTNLLKYTLQLRNSNNKTGEDYILSCVKDDEKNFFNSNNAKDSEPENADANGAYHIGLKGIMLIKKMKKQSDKNQKIDLRISNEEYFNEMCSKEQSKKKES

SEQ ID NO: 733 - protein, 1353 aa, synthetic construct
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWRTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVNLQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNKPTLADGWSEGKIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMFFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 734 - protein, 1353 aa, synthetic construct
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWDTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVNLQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNKPTLARGWSEGKIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMFFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 735 - protein, 1353 aa, synthetic construct
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWRTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVNLQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNKPTLARGWSEGKIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMFFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 736 - protein, 1353 aa, synthetic construct
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWRTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVNLQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNKPTLADGWSEGRIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMFFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 737 - protein, 1353 aa, synthetic construct
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWDTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVNLQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNKPTLARGWSEGRIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMFFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 738 - protein, 1353 aa, synthetic construct
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWRTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVNLQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNKPTLARGWSEGRIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMFFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 739 - protein, 1353 aa, synthetic construct
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWRTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVALQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNKPTLADGWSEGRIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMFFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 740 - protein, 1353 aa, synthetic construct
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWDTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVNLQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNRPTLADGWSEGKIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMFFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 741 - protein, 1353 aa, synthetic construct
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWDTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVNLQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNKPTLADGWSEGKIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMLFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 742 - protein, 1353 aa, synthetic construct
MTITNQQPFQDFVGLSEIQKTLRWRLIPIGKTKENMKKYNVFQEDEIRHKYYPVLKNACDDFYRQHIDQQLADIQFDWHKLDEVSNTNDNEKITKIQAVYRKLLFNRLNDSIDTAGNKRKSTLSYSFGDLFKAKLITTILPEFIIKRYQGDDLEEAKAALDCYKRFTSRLTGFWDTRKNIFTAEDIATGCPNRLVNENFPIFQKNADLYEENKKHLADKFKDFEEHLKENNKLSQDESLDDFFTINAFNKVCTQAGITLYNTLLGGFTKKDNTKIQGINEIVNLQQQAINKGKKAENRDNIKLLKLTRLRKQILAKEDSTSFLIEQIENDQDLFQKIFDFFDLLKLKEVENLDSFEQYSSLINLLDQGDKNKIFISAKYLTKISHQISKDWHFINKGISLLVESDNTNNEYQRYLEIYNDDKDIERLRKQIYFSVADLEKAIDLAGQDENRDVSEISILDYVQNLDEDCNFERDLFDLLERIKQIMKSGEKLLGNTEAINIIKDFLDTIMIRHSRWQVFTCELSDEYDQNFYSTYNLVSETMSNIVRLYNLARNYLSRKPDRMKKMRINFNRPTLADGWSEGKIADNLSMLFRKDGLYYLGIIKDRVTYNKLLEISGSNEANIKKNTSSYERMNYYLLPDAFRSIPKSSLAMRAVKEYFENNPSSEDYYIETDQFAEPFRISRKIYDMQYTDLHNDKKKYQIDYLRDTEDETGYRNALTDRINFCKDFCNNYEGRKHFDYSQIKDAENYYTVNEFYSDIDKCSYNVYFTPILESEINKLIDEGKLYLFQLYNKDFSEYSTGKPNLHTIYWRALFSDENLEKKNIKLNGQAELFFRPKQIATPVTHKKGSIMVNRFDVNGKPIPMEVYQEVKEYKNGLKSWEDLSKETKTGLENNQYKFFEAEFEIIKDRRYTEDQMLFHVPISFNWHISSSPRINDLANQHIVNSDDMHIIGIDRGERHLLYYSVINMNGQIIEQGSLNNITEQSPNEENGTRTIPYKDMLRQREDERAQARLNWQAIDKIKDLKDGYLGQVVHFLAKLIIKYNAIVIMEDLNFGFKRGRFKVERQVYQKFEMALLKKLNALVFKDRDINEIGGALKPWQLTRPIDSYDKMGKQNGILFYVPAAYTSAVDPVTGFANLFNLRNIKSTERIEFFSKFEAIEYHQNEDIISFTFDYNKFSNISRIKNLNKSKWQVYTNGERIRWDNNERKHKSEDLTETMKNYLIDADIDYVNNPDILGELLKMDDASKKNFANKIFNIFSLTVELRNTVKDSADNGTDYNEIDYIISPVKDSYGNFFDSRMNLDNLPNNGDANGAYNIARKGLLYVKQLQNSVRDGKNPSLSISNKDWFKFITS

SEQ ID NO: 743 - protein, 1294 aa, synthetic construct
MSSVFSDFTNQYQLTKTLRFELKPVGKTLEYIKENGLLSDDKLRAENYTKIKDIIDDFHKDFIDKSLKQADIRWDDLKNGIENYRKDNSKKNKDELEKLQKRYRNEIVECFKKDKEIFSYLFKKELITEILPEYIKNKETFEAERDILSSFSRFATYFTSFQRTRKNIYSKNAISTAISYRLVHQNFPKFISNIEVFNKISEVCADIILDTERELAEILDGRRLRDVFSIEYYNNVLCQSGIDDFNRCIGGYSKDDGVKIRGLNEFVNLFNQKNNGLMLSKMTPLYKQILSDREKISFIPEKFDNDFQVKSAINEYCNGLLKEDIAALVDELVLNYAQGNSNNIYIVGKEFTNLSKMLTDSWSTINDSLYLFAVSLFGDNDKKSTKEKINRWIKSAEFSVKTMKDALLMNGIDVKIEKLFDTIKQKTDVIIKEYEAIKPYLCNDEKFLGNETGIERVKSLLDAIMELMHMLKVFNVSNELDRDMSFYSVYDTIYNNLTEVIQLYNKVRNYATQKPYSEDKYKLNFENKGNFLNGWVDSKTESNDNGTQYGGYLFRKRNLLNQYDYYLGVSSDVKLFRECKDSNVFCDYERLYYYQPKVSTIYGSAYKGEKTYAKDKSELITIIDDFVSCCDIDNDKLIAFKEKVELTPNGYINWLKKEYPSIFEKLICNQEFKNKNNEIIGNLKKALKDLIPKMPYVQQYIEKQYTIVNEIISDIEEISHNKILTYIKINRREMENALSRGTKRLYLFKITNKDLSFAESFEKGYRKEIKNKNLHTLYFEQLMSGGNSVFDLGTGSIFYRPASIESPFVHKKGEILIDRKDKNGNPIPMDIYDQLFNHFNYGSTLSEEAKKYKDIVVVKNAKHDIIKDKRFTQDKFLFHLSITINYKATGSGYINAKVLNAISNNPNVNIIGIDRGERNLLYVSLINQRGDIITQKSFNIAGGFDYAAKLTQYEKNRDIARKDWKQIGNIKELKEGYLSVVIHEIIQMMIKNNAIIVMEDLNFGFKRGRFKFERQVYQKFEKMLIDKLNYLADKKKNPADEGGILRGYQLTEAFTSFQKLGKQSGFIFYVPAGYTSKIDPTTGFVSLINLKWTSIENAQKIISAMDFIRYNSSEDYFEFGIDYDKLRTAQTDFRKKWTVCTFGDRYTHTQNKATSNHTTEKVNLTAKLKAVLDKYSIDYDKGEDIRDILCKSNSKELLETVLYVLKLAMQMRSTSPEDDVDMIISPVKNDDGKFFVSGNDEKLPIDADANGAFHIALKGLMYIKRIKNGKIECFDKGMATYEWLKFMQNREYKS

SEQ ID NO: 744 - protein, 1294 aa, synthetic construct
MSSVFSDFTNQYQLTKTLRFELKPVGKTLEYIKENGLLSDDKLRAENYTKIKDIIDDFHKDFIDKSLKQADIRWDDLKNGIENYRKDNSKKNKDELEKLQKRYRNEIVECFKKDKEIFSYLFKKELITEILPEYIKNKETFEAERDILSSFSRFATYFTSFQETRKNIYSKNAISTAISYRLVHQNFPKFISNIEVFNKISEVCADIILDTERELAEILDGRRLRDVFSIEYYNNVLCQSGIDDFNRCIGGYSKDDGVKIRGLNEFVNLFNQKNNGLMLSKMTPLYKQILSDREKISFIPEKFDNDFQVKSAINEYCNGLLKEDIAALVDELVLNYAQGNSNNIYIVGKEFTNLSKMLTDSWSTINDSLYLFAVSLFGDNDKKSTKEKINRWIKSAEFSVKTMKDALLMNGIDVKIEKLFDTIKQKTDVIIKEYEAIKPYLCNDEKFLGNETGIERVKSLLDAIMELMHMLKVFNVSNELDRDMSFYSVYDTIYNNLTEVIQLYNKVRNYATQKPYSEDKYKLNFENKGNFLRGWVDSKTESNDNGTQYGGYLFRKRNLLNQYDYYLGVSSDVKLFRECKDSNVFCDYERLYYYQPKVSTIYGSAYKGEKTYAKDKSELITIIDDFVSCCDIDNDKLIAFKEKVELTPNGYINWLKKEYPSIFEKLICNQEFKNKNNEIIGNLKKALKDLIPKMPYVQQYIEKQYTIVNEIISDIEEISHNKILTYIKINRREMENALSRGTKRLYLFKITNKDLSFAESFEKGYRKEIKNKNLHTLYFEQLMSGGNSVFDLGTGSIFYRPASIESPFVHKKGEILIDRKDKNGNPIPMDIYDQLFNHFNYGSTLSEEAKKYKDIVVVKNAKHDIIKDKRFTQDKFLFHLSITINYKATGSGYINAKVLNAISNNPNVNIIGIDRGERNLLYVSLINQRGDIITQKSFNIAGGFDYAAKLTQYEKNRDIARKDWKQIGNIKELKEGYLSVVIHEIIQMMIKNNAIIVMEDLNFGFKRGRFKFERQVYQKFEKMLIDKLNYLADKKKNPADEGGILRGYQLTEAFTSFQKLGKQSGFIFYVPAGYTSKIDPTTGFVSLINLKWTSIENAQKIISAMDFIRYNSSEDYFEFGIDYDKLRTAQTDFRKKWTVCTFGDRYTHTQNKATSNHTTEKVNLTAKLKAVLDKYSIDYDKGEDIRDILCKSNSKELLETVLYVLKLAMQMRSTSPEDDVDMIISPVKNDDGKFFVSGNDEKLPIDADANGAFHIALKGLMYIKRIKNGKIECFDKGMATYEWLKFMQNREYKS

SEQ ID NO: 745 - protein, 1294 aa, synthetic construct
MSSVFSDFTNQYQLTKTLRFELKPVGKTLEYIKENGLLSDDKLRAENYTKIKDIIDDFHKDFIDKSLKQADIRWDDLKNGIENYRKDNSKKNKDELEKLQKRYRNEIVECFKKDKEIFSYLFKKELITEILPEYIKNKETFEAERDILSSFSRFATYFTSFQETRKNIYSKNAISTAISYRLVHQNFPKFISNIEVFNKISEVCADIILDTERELAEILDGRRLRDVFSIEYYNNVLCQSGIDDFNRCIGGYSKDDGVKIRGLNEFVNLFNQKNNGLMLSKMTPLYKQILSDREKISFIPEKFDNDFQVKSAINEYCNGLLKEDIAALVDELVLNYAQGNSNNIYIVGKEFTNLSKMLTDSWSTINDSLYLFAVSLFGDNDKKSTKEKINRWIKSAEFSVKTMKDALLMNGIDVKIEKLFDTIKQKTDVIIKEYEAIKPYLCNDEKFLGNETGIERVKSLLDAIMELMHMLKVFNVSNELDRDMSFYSVYDTIYNNLTEVIQLYNKVRNYATQKPYSEDKYKLNFENKGNFLNGWVDSRTESNDNGTQYGGYLFRKRNLLNQYDYYLGVSSDVKLFRECKDSNVFCDYERLYYYQPKVSTIYGSAYKGEKTYAKDKSELITIIDDFVSCCDIDNDKLIAFKEKVELTPNGYINWLKKEYPSIFEKLICNQEFKNKNNEIIGNLKKALKDLIPKMPYVQQYIEKQYTIVNEIISDIEEISHNKILTYIKINRREMENALSRGTKRLYLFKITNKDLSFAESFEKGYRKEIKNKNLHTLYFEQLMSGGNSVFDLGTGSIFYRPASIESPFVHKKGEILIDRKDKNGNPIPMDIYDQLFNHFNYGSTLSEEAKKYKDIVVVKNAKHDIIKDKRFTQDKFLFHLSITINYKATGSGYINAKVLNAISNNPNVNIIGIDRGERNLLYVSLINQRGDIITQKSFNIAGGFDYAAKLTQYEKNRDIARKDWKQIGNIKELKEGYLSVVIHEIIQMMIKNNAIIVMEDLNFGFKRGRFKFERQVYQKFEKMLIDKLNYLADKKKNPADEGGILRGYQLTEAFTSFQKLGKQSGFIFYVPAGYTSKIDPTTGFVSLINLKWTSIENAQKIISAMDFIRYNSSEDYFEFGIDYDKLRTAQTDFRKKWTVCTFGDRYTHTQNKATSNHTTEKVNLTAKLKAVLDKYSIDYDKGEDIRDILCKSNSKELLETVLYVLKLAMQMRSTSPEDDVDMIISPVKNDDGKFFVSGNDEKLPIDADANGAFHIALKGLMYIKRIKNGKIECFDKGMATYEWLKFMQNREYKS

SEQ ID NO: 746 - protein, 1294 aa, synthetic construct
MSSVFSDFTNQYQLTKTLRFELKPVGKTLEYIKENGLLSDDKLRAENYTKIKDIIDDFHKDFIDKSLKQADIRWDDLKNGIENYRKDNSKKNKDELEKLQKRYRNEIVECFKKDKEIFSYLFKKELITEILPEYIKNKETFEAERDILSSFSRFATYFTSFQRTRKNIYSKNAISTAISYRLVHQNFPKFISNIEVFNKISEVCADIILDTERELAEILDGRRLRDVFSIEYYNNVLCQSGIDDFNRCIGGYSKDDGVKIRGLNEFVNLFNQKNNGLMLSKMTPLYKQILSDREKISFIPEKFDNDFQVKSAINEYCNGLLKEDIAALVDELVLNYAQGNSNNIYIVGKEFTNLSKMLTDSWSTINDSLYLFAVSLFGDNDKKSTKEKINRWIKSAEFSVKTMKDALLMNGIDVKIEKLFDTIKQKTDVIIKEYEAIKPYLCNDEKFLGNETGIERVKSLLDAIMELMHMLKVFNVSNELDRDMSFYSVYDTIYNNLTEVIQLYNKVRNYATQKPYSEDKYKLNFENKGNFLRGWVDSKTESNDNGTQYGGYLFRKRNLLNQYDYYLGVSSDVKLFRECKDSNVFCDYERLYYYQPKVSTIYGSAYKGEKTYAKDKSELITIIDDFVSCCDIDNDKLIAFKEKVELTPNGYINWLKKEYPSIFEKLICNQEFKNKNNEIIGNLKKALKDLIPKMPYVQQYIEKQYTIVNEIISDIEEISHNKILTYIKINRREMENALSRGTKRLYLFKITNKDLSFAESFEKGYRKEIKNKNLHTLYFEQLMSGGNSVFDLGTGSIFYRPASIESPFVHKKGEILIDRKDKNGNPIPMDIYDQLFNHFNYGSTLSEEAKKYKDIVVVKNAKHDIIKDKRFTQDKFLFHLSITINYKATGSGYINAKVLNAISNNPNVNIIGIDRGERNLLYVSLINQRGDIITQKSFNIAGGFDYAAKLTQYEKNRDIARKDWKQIGNIKELKEGYLSVVIHEIIQMMIKNNAIIVMEDLNFGFKRGRFKFERQVYQKFEKMLIDKLNYLADKKKNPADEGGILRGYQLTEAFTSFQKLGKQSGFIFYVPAGYTSKIDPTTGFVSLINLKWTSIENAQKIISAMDFIRYNSSEDYFEFGIDYDKLRTAQTDFRKKWTVCTFGDRYTHTQNKATSNHTTEKVNLTAKLKAVLDKYSIDYDKGEDIRDILCKSNSKELLETVLYVLKLAMQMRSTSPEDDVDMIISPVKNDDGKFFVSGNDEKLPIDADANGAFHIALKGLMYIKRIKNGKIECFDKGMATYEWLKFMQNREYKS

SEQ ID NO: 747 - protein, 1294 aa, synthetic construct
MSSVFSDFTNQYQLTKTLRFELKPVGKTLEYIKENGLLSDDKLRAENYTKIKDIIDDFHKDFIDKSLKQADIRWDDLKNGIENYRKDNSKKNKDELEKLQKRYRNEIVECFKKDKEIFSYLFKKELITEILPEYIKNKETFEAERDILSSFSRFATYFTSFQRTRKNIYSKNAISTAISYRLVHQNFPKFISNIEVFNKISEVCADIILDTERELAEILDGRRLRDVFSIEYYNNVLCQSGIDDFNRCIGGYSKDDGVKIRGLNEFVNLFNQKNNGLMLSKMTPLYKQILSDREKISFIPEKFDNDFQVKSAINEYCNGLLKEDIAALVDELVLNYAQGNSNNIYIVGKEFTNLSKMLTDSWSTINDSLYLFAVSLFGDNDKKSTKEKINRWIKSAEFSVKTMKDALLMNGIDVKIEKLFDTIKQKTDVIIKEYEAIKPYLCNDEKFLGNETGIERVKSLLDAIMELMHMLKVFNVSNELDRDMSFYSVYDTIYNNLTEVIQLYNKVRNYATQKPYSEDKYKLNFENKGNFLNGWVDSRTESNDNGTQYGGYLFRKRNLLNQYDYYLGVSSDVKLFRECKDSNVFCDYERLYYYQPKVSTIYGSAYKGEKTYAKDKSELITIIDDFVSCCDIDNDKLIAFKEKVELTPNGYINWLKKEYPSIFEKLICNQEFKNKNNEIIGNLKKALKDLIPKMPYVQQYIEKQYTIVNEIISDIEEISHNKILTYIKINRREMENALSRGTKRLYLFKITNKDLSFAESFEKGYRKEIKNKNLHTLYFEQLMSGGNSVFDLGTGSIFYRPASIESPFVHKKGEILIDRKDKNGNPIPMDIYDQLFNHFNYGSTLSEEAKKYKDIVVVKNAKHDIIKDKRFTQDKFLFHLSITINYKATGSGYINAKVLNAISNNPNVNIIGIDRGERNLLYVSLINQRGDIITQKSFNIAGGFDYAAKLTQYEKNRDIARKDWKQIGNIKELKEGYLSVVIHEIIQMMIKNNAIIVMEDLNFGFKRGRFKFERQVYQKFEKMLIDKLNYLADKKKNPADEGGILRGYQLTEAFTSFQKLGKQSGFIFYVPAGYTSKIDPTTGFVSLINLKWTSIENAQKIISAMDFIRYNSSEDYFEFGIDYDKLRTAQTDFRKKWTVCTFGDRYTHTQNKATSNHTTEKVNLTAKLKAVLDKYSIDYDKGEDIRDILCKSNSKELLETVLYVLKLAMQMRSTSPEDDVDMIISPVKNDDGKFFVSGNDEKLPIDADANGAFHIALKGLMYIKRIKNGKIECFDKGMATYEWLKFMQNREYKS

SEQ ID NO: 748 - protein, 1294 aa, synthetic construct
MSSVFSDFTNQYQLTKTLRFELKPVGKTLEYIKENGLLSDDKLRAENYTKIKDIIDDFHKDFIDKSLKQADIRWDDLKNGIENYRKDNSKKNKDELEKLQKRYRNEIVECFKKDKEIFSYLFKKELITEILPEYIKNKETFEAERDILSSFSRFATYFTSFQETRKNIYSKNAISTAISYRLVHQNFPKFISNIEVFNKISEVCADIILDTERELAEILDGRRLRDVFSIEYYNNVLCQSGIDDFNRCIGGYSKDDGVKIRGLNEFVNLFNQKNNGLMLSKMTPLYKQILSDREKISFIPEKFDNDFQVKSAINEYCNGLLKEDIAALVDELVLNYAQGNSNNIYIVGKEFTNLSKMLTDSWSTINDSLYLFAVSLFGDNDKKSTKEKINRWIKSAEFSVKTMKDALLMNGIDVKIEKLFDTIKQKTDVIIKEYEAIKPYLCNDEKFLGNETGIERVKSLLDAIMELMHMLKVFNVSNELDRDMSFYSVYDTIYNNLTEVIQLYNKVRNYATQKPYSEDKYKLNFENKGNFLRGWVDSRTESNDNGTQYGGYLFRKRNLLNQYDYYLGVSSDVKLFRECKDSNVFCDYERLYYYQPKVSTIYGSAYKGEKTYAKDKSELITIIDDFVSCCDIDNDKLIAFKEKVELTPNGYINWLKKEYPSIFEKLICNQEFKNKNNEIIGNLKKALKDLIPKMPYVQQYIEKQYTIVNEIISDIEEISHNKILTYIKINRREMENALSRGTKRLYLFKITNKDLSFAESFEKGYRKEIKNKNLHTLYFEQLMSGGNSVFDLGTGSIFYRPASIESPFVHKKGEILIDRKDKNGNPIPMDIYDQLFNHFNYGSTLSEEAKKYKDIVVVKNAKHDIIKDKRFTQDKFLFHLSITINYKATGSGYINAKVLNAISNNPNVNIIGIDRGERNLLYVSLINQRGDIITQKSFNIAGGFDYAAKLTQYEKNRDIARKDWKQIGNIKELKEGYLSVVIHEIIQMMIKNNAIIVMEDLNFGFKRGRFKFERQVYQKFEKMLIDKLNYLADKKKNPADEGGILRGYQLTEAFTSFQKLGKQSGFIFYVPAGYTSKIDPTTGFVSLINLKWTSIENAQKIISAMDFIRYNSSEDYFEFGIDYDKLRTAQTDFRKKWTVCTFGDRYTHTQNKATSNHTTEKVNLTAKLKAVLDKYSIDYDKGEDIRDILCKSNSKELLETVLYVLKLAMQMRSTSPEDDVDMIISPVKNDDGKFFVSGNDEKLPIDADANGAFHIALKGLMYIKRIKNGKIECFDKGMATYEWLKFMQNREYKS

SEQ ID NO: 749 - protein, 1294 aa, synthetic construct
MSSVFSDFTNQYQLTKTLRFELKPVGKTLEYIKENGLLSDDKLRAENYTKIKDIIDDFHKDFIDKSLKQADIRWDDLKNGIENYRKDNSKKNKDELEKLQKRYRNEIVECFKKDKEIFSYLFKKELITEILPEYIKNKETFEAERDILSSFSRFATYFTSFQRTRKNIYSKNAISTAISYRLVHQNFPKFISNIEVFNKISEVCADIILDTERELAEILDGRRLRDVFSIEYYNNVLCQSGIDDFNRCIGGYSKDDGVKIRGLNEFVNLFNQKNNGLMLSKMTPLYKQILSDREKISFIPEKFDNDFQVKSAINEYCNGLLKEDIAALVDELVLNYAQGNSNNIYIVGKEFTNLSKMLTDSWSTINDSLYLFAVSLFGDNDKKSTKEKINRWIKSAEFSVKTMKDALLMNGIDVKIEKLFDTIKQKTDVIIKEYEAIKPYLCNDEKFLGNETGIERVKSLLDAIMELMHMLKVFNVSNELDRDMSFYSVYDTIYNNLTEVIQLYNKVRNYATQKPYSEDKYKLNFENKGNFLRGWVDSRTESNDNGTQYGGYLFRKRNLLNQYDYYLGVSSDVKLFRECKDSNVFCDYERLYYYQPKVSTIYGSAYKGEKTYAKDKSELITIIDDFVSCCDIDNDKLIAFKEKVELTPNGYINWLKKEYPSIFEKLICNQEFKNKNNEIIGNLKKALKDLIPKMPYVQQYIEKQYTIVNEIISDIEEISHNKILTYIKINRREMENALSRGTKRLYLFKITNKDLSFAESFEKGYRKEIKNKNLHTLYFEQLMSGGNSVFDLGTGSIFYRPASIESPFVHKKGEILIDRKDKNGNPIPMDIYDQLFNHFNYGSTLSEEAKKYKDIVVVKNAKHDIIKDKRFTQDKFLFHLSITINYKATGSGYINAKVLNAISNNPNVNIIGIDRGERNLLYVSLINQRGDIITQKSFNIAGGFDYAAKLTQYEKNRDIARKDWKQIGNIKELKEGYLSVVIHEIIQMMIKNNAIIVMEDLNFGFKRGRFKFERQVYQKFEKMLIDKLNYLADKKKNPADEGGILRGYQLTEAFTSFQKLGKQSGFIFYVPAGYTSKIDPTTGFVSLINLKWTSIENAQKIISAMDFIRYNSSEDYFEFGIDYDKLRTAQTDFRKKWTVCTFGDRYTHTQNKATSNHTTEKVNLTAKLKAVLDKYSIDYDKGEDIRDILCKSNSKELLETVLYVLKLAMQMRSTSPEDDVDMIISPVKNDDGKFFVSGNDEKLPIDADANGAFHIALKGLMYIKRIKNGKIECFDKGMATYEWLKFMQNREYKS

SEQ ID NO: 750 - protein, 1294 aa, synthetic construct
MSSVFSDFTNQYQLTKTLRFELKPVGKTLEYIKENGLLSDDKLRAENYTKIKDIIDDFHKDFIDKSLKQADIRWDDLKNGIENYRKDNSKKNKDELEKLQKRYRNEIVECFKKDKEIFSYLFKKELITEILPEYIKNKETFEAERDILSSFSRFATYFTSFQRTRKNIYSKNAISTAISYRLVHQNFPKFISNIEVFNKISEVCADIILDTERELAEILDGRRLRDVFSIEYYNNVLCQSGIDDFNRCIGGYSKDDGVKIRGLNEFVALFNQKNNGLMLSKMTPLYKQILSDREKISFIPEKFDNDFQVKSAINEYCNGLLKEDIAALVDELVLNYAQGNSNNIYIVGKEFTNLSKMLTDSWSTINDSLYLFAVSLFGDNDKKSTKEKINRWIKSAEFSVKTMKDALLMNGIDVKIEKLFDTIKQKTDVIIKEYEAIKPYLCNDEKFLGNETGIERVKSLLDAIMELMHMLKVFNVSNELDRDMSFYSVYDTIYNNLTEVIQLYNKVRNYATQKPYSEDKYKLNFENKGNFLNGWVDSRTESNDNGTQYGGYLFRKRNLLNQYDYYLGVSSDVKLFRECKDSNVFCDYERLYYYQPKVSTIYGSAYKGEKTYAKDKSELITIIDDFVSCCDIDNDKLIAFKEKVELTPNGYINWLKKEYPSIFEKLICNQEFKNKNNEIIGNLKKALKDLIPKMPYVQQYIEKQYTIVNEIISDIEEISHNKILTYIKINRREMENALSRGTKRLYLFKITNKDLSFAESFEKGYRKEIKNKNLHTLYFEQLMSGGNSVFDLGTGSIFYRPASIESPFVHKKGEILIDRKDKNGNPIPMDIYDQLFNHFNYGSTLSEEAKKYKDIVVVKNAKHDIIKDKRFTQDKFLFHLSITINYKATGSGYINAKVLNAISNNPNVNIIGIDRGERNLLYVSLINQRGDIITQKSFNIAGGFDYAAKLTQYEKNRDIARKDWKQIGNIKELKEGYLSVVIHEIIQMMIKNNAIIVMEDLNFGFKRGRFKFERQVYQKFEKMLIDKLNYLADKKKNPADEGGILRGYQLTEAFTSFQKLGKQSGFIFYVPAGYTSKIDPTTGFVSLINLKWTSIENAQKIISAMDFIRYNSSEDYFEFGIDYDKLRTAQTDFRKKWTVCTFGDRYTHTQNKATSNHTTEKVNLTAKLKAVLDKYSIDYDKGEDIRDILCKSNSKELLETVLYVLKLAMQMRSTSPEDDVDMIISPVKNDDGKFFVSGNDEKLPIDADANGAFHIALKGLMYIKRIKNGKIECFDKGMATYEWLKFMQNREYKS

SEQ ID NO: 751 - protein, 1294 aa, synthetic construct
MSSVFSDFTNQYQLTKTLRFELKPVGKTLEYIKENGLLSDDKLRAENYTKIKDIIDDFHKDFIDKSLKQADIRWDDLKNGIENYRKDNSKKNKDELEKLQKRYRNEIVECFKKDKEIFSYLFKKELITEILPEYIKNKETFEAERDILSSFSRFATYFTSFQETRKNIYSKNAISTAISYRLVHQNFPKFISNIEVFNKISEVCADIILDTERELAEILDGRRLRDVFSIEYYNNVLCQSGIDDFNRCIGGYSKDDGVKIRGLNEFVNLFNQKNNGLMLSKMTPLYKQILSDREKISFIPEKFDNDFQVKSAINEYCNGLLKEDIAALVDELVLNYAQGNSNNIYIVGKEFTNLSKMLTDSWSTINDSLYLFAVSLFGDNDKKSTKEKINRWIKSAEFSVKTMKDALLMNGIDVKIEKLFDTIKQKTDVIIKEYEAIKPYLCNDEKFLGNETGIERVKSLLDAIMELMHMLKVFNVSNELDRDMSFYSVYDTIYNNLTEVIQLYNKVRNYATQKPYSEDKYKLNFERKGNFLNGWVDSKTESNDNGTQYGGYLFRKRNLLNQYDYYLGVSSDVKLFRECKDSNVFCDYERLYYYQPKVSTIYGSAYKGEKTYAKDKSELITIIDDFVSCCDIDNDKLIAFKEKVELTPNGYINWLKKEYPSIFEKLICNQEFKNKNNEIIGNLKKALKDLIPKMPYVQQYIEKQYTIVNEIISDIEEISHNKILTYIKINRREMENALSRGTKRLYLFKITNKDLSFAESFEKGYRKEIKNKNLHTLYFEQLMSGGNSVFDLGTGSIFYRPASIESPFVHKKGEILIDRKDKNGNPIPMDIYDQLFNHFNYGSTLSEEAKKYKDIVVVKNAKHDIIKDKRFTQDKFLFHLSITINYKATGSGYINAKVLNAISNNPNVNIIGIDRGERNLLYVSLINQRGDIITQKSFNIAGGFDYAAKLTQYEKNRDIARKDWKQIGNIKELKEGYLSVVIHEIIQMMIKNNAIIVMEDLNFGFKRGRFKFERQVYQKFEKMLIDKLNYLADKKKNPADEGGILRGYQLTEAFTSFQKLGKQSGFIFYVPAGYTSKIDPTTGFVSLINLKWTSIENAQKIISAMDFIRYNSSEDYFEFGIDYDKLRTAQTDFRKKWTVCTFGDRYTHTQNKATSNHTTEKVNLTAKLKAVLDKYSIDYDKGEDIRDILCKSNSKELLETVLYVLKLAMQMRSTSPEDDVDMIISPVKNDDGKFFVSGNDEKLPIDADANGAFHIALKGLMYIKRIKNGKIECFDKGMATYEWLKFMQNREYKS

SEQ ID NO: 752 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWRNRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDSPTLANGWDENKIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFFFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 753 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWENRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDSPTLARGWDENKIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFFFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 754 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWENRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDSPTLANGWDENRIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFFFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 755 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWRNRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDSPTLARGWDENKIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFFFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 756 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWRNRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDSPTLANGWDENRIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFFFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 757 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWENRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDSPTLARGWDENRIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFFFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 758 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWRNRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDSPTLARGWDENRIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFFFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 759 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWRNRENLFSDKEQHTAIAFRIVHENFPRFYGNIKAFENAPQEIREEFIGKFPATLEAFNDTLTQAGIDSYNSHIGGERNAQSGVEKGRGFNEKIAQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDSPTLANGWDENRIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFFFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 760 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWENRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDRPTLANGWDENKIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFFFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 761 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWENRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDSPTLANGWDENKIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFLFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 762 - protein, 1296 aa, synthetic construct
MESPNNIFSNFTNLYQLQKTLRFELKPVPRDGETPEETLNRLKSSAFFMNDSRRESAYAEVKTIIDDFFRDFIDISLKKVKIDWQPLASAIDSKDEKVQQQQSDSIRKKILESFGFSKDSKEAKKTKKEIFGKDLFEKIIPNWLSEKVRAQKLTQEEYERKSKKLLEFKGFTTYFSGFWENRENLFSDKEQHTAIAFRIVHENFPRFYGNIKAFENAPQEIREEFIGKFPATLEAFNDTLTQAGIDSYNSHIGGERNAQSGVEKGRGFNEKITQWNQAHKEKKAQKMKLLYKQILSDRESAWSGRLILDKQDLTERLKKLREELFEKKNANGETAIESAVELFASLTDFDFTKIWFAEKNVPALALSLFGQWDALNSNLKISEGESDSKGKKEKLFSLQEIEEAIKFVRKNNESTEENPTLTSLFDFLGTIKYSDDSGIRFVPISKAAQAAQKELSSAILISEQADELLGDDAKIAGIKSALDRVMDIFHKVKVLQVREKNLQAKETDAAFYAEFENIFSPFSSCASVYDSVRNYLTRKPYSTEKMKLCFDRPTLANGWDENKIPDYRAFILRKDGKYFLGLLNNKSSAKERKAVVECEVTIDDSRQECYERMIYKYLPSPVKMLPKIFFSRKGIETYNPADELIEKSTRNDDVAKLVRFYQTAIPQYNNGDYQAFNFVFKKPEAYSTVNEFYGDVEKQNYRLDFKKVPVEKIKEFVENETLFLFEIYNKDFSDNSGGRKNLHTLYWLSAFSSENQSANFPIKLNGEAEIFWRAASKPSAESGIHKAGSVLVNRRDSEGKPIPEKTYLEIYRYKNGKLHKDELSEDARKLIESGKIVCKKASYETRKDRRYTEDKFLFHIPLTFNRTPKSGKDISPKEFNVRTRALLCNKTNSVKIIGIDRGERNLISLVLIDGNGKILRQKSFNEIEESSRHSTRSTNYQELLRIRETERQEARKSWKTIAKIAELKEGYVSQVVHAISKLIVEHNAIVVLEDLNVGFKRGRFAVERQVYQKFERALIEKLNFLVFKERKADELGGVLNALQLTNKFESFEKLGNQSGILFYVPAGYTSKIDPKTGFVNIFDLRGITNAKAKKELFSKFSRIYYSEKDDAFAFEFDYSNFKTHKQPIAKTKWTIYSYGKRLIWNPKSRKTDPPESPTQKLKEALGCAEINWRTSENLVNAICNVSEEGKFRTDFWDKIFRAFKCTLQMRNSIAGQTGSDADYLISPVKGADGAFFDSRAEAKKDSHQERLPTDADNNGAYHIALKGLMGIHRKFAAGWQKNDSWFKFVQNREFEK

SEQ ID NO: 763 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFRTRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDNPTLADGWDKNKESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKIFFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 764 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFETRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDNPTLARGWDKNKESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKIFFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 765 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFETRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDNPTLADGWDKNRESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKIFFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 766 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFRTRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDNPTLARGWDKNKESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKIFFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 767 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFRTRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDNPTLADGWDKNRESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKIFFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 768 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFETRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDNPTLARGWDKNRESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKIFFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 769 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFRTRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDNPTLARGWDKNRESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKIFFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 770 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFRTRKNFYKDDGTSTALATRIIDQNLKRFCDNIQIFECLKEKVDFREVEENFGKSLSEIFSINFYNTCFLQDGINFYNKVLGGEALKNGEKLKGLNEFIAKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDNPTLADGWDKNRESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKIFFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 771 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFETRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDRPTLADGWDKNKESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKIFFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 772 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFETRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDNPTLADGWDKNKESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKILFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 773 - protein, 1271 aa, synthetic construct
MNNSLFSSFTNQYSLSKTLRFELKPVGKTQQMLEETKVFQRDETIQKKYEATKPYFDRLHREFVKEALESKVLSELDGYFEIFKKWKIDKKVYEKEIQKKEGELRKGIVQFFNTQGKEWAEKYSGLKNKNIEILFEEAVFKAILKERYENEEGSMVADESTGELVSIFDSWKGFSGYFGKFFETRKNFYKDDGTSTALATRIIDQNLKRFCDNIQIFECLKEKVDFREVEENFGKSLSEIFSINFYNTCFLQDGINFYNKVLGGEALKNGEKLKGLNEFINKYRQDHKGEKLPFFKSLDKQILSEKEQFIDEIENDEKLLDILKSFHKTAQLKALILKRLFEDFLVDQGKYHLEEIYLSKEAINTIFHKWTNETETVEEALYEVLRSAKIISTSAKKKDGGYSFSDFIALSHIKESLEKIPSKKFWKERYYEIQNFEEKQIWEQFLAIFEFEFLSLFRSEKTNSETGEKVESGYEIFEKDFSNLLSHFVFDQNAKIIIKNFSDSILTIYQMAKYFALEKKRAWQTDYELDAFYTNPENGYLQFYENAYEEIVQVYNKLRNYLTKKPYSEEKWKLNFDRPTLADGWDKNKESDNSAVILRKNGEYYLGLMSKGNNKIFDDRNIQNFSKNIEQGKYEKVVYKFFPDQAKMFPKVCFSAKGLEFFQPSEEIWNIYKNAEFKKGETFSINSMQKLIDFYKDCLKKYDGWKGYDFEHLKTTELYQENIGEFFRDVSEDGYKITFQDISESYINEKNQNGELYLFQIKNKDWNEGATGAKNLHTLYFESLFSEENRKQNFPMKLNGQAEIFYRPKTKDLKKEKITTKSGKILEKEEKAFQKNRFTENKILFHVPLTLNRTKSDPFQFNVKINNFLANNPEINIIGVDRGEKHLAYFSVITQEGKILDSGTLNEITGVNYAEKLEEKAKNREQERKDWQTVEGIKDLKKGYISQVVRKLADLAIQHNAIIVFEDLNMRFKQIRGGIEKSVYQQLEKALIEKLNFLVNKGEKNLEKAGHLLKAYQLAAPFTTFKDMGKQTGIIFYTQAAYTSRIDPITGWRPHLYLKYSSAEKAKADIQNFTKIEFSNGRFEFTYDIKNFRTQKEYPQNTIWTICSSVERFRWNRHLNNNKGGYDHYASITENLLQLLKEAEIDIMTGNILGQIESLNTKEHVQFFKDLIFYINLICQIRNTDDQAKIFDKQDFIFSPVEPFFDSRKSEEFGKDLPKNGDDNGAYNIARKGILVLKKISDFSEKNGGCEKMKWDNLFVSNAEWDNFVSH

SEQ ID NO: 774 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNRSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDNGTLAAGWDITKEKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFEFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 775 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNTSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDNGTLARGWDITKEKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFEFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 776 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNTSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDNGTLAAGWDITREKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFEFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 777 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNRSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDNGTLARGWDITKEKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFEFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 778 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNRSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDNGTLAAGWDITREKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFEFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 779 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNTSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDNGTLARGWDITREKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFEFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 780 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNRSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDNGTLARGWDITREKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFEFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 781 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNRSRNNIFKSGSSASIPYRCINDNFAKFGENILLFESLPPQVREKLKECCPVELFRPQSYDRYLCQAGVKEYNKAIGGYVNEDGSKIQGLNEILAECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDNGTLAAGWDITREKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFEFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 782 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNTSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDRGTLAAGWDITKEKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFEFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 783 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNTSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDNGTLAAGWDITKEKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFLFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 784 - protein, 1210 aa, synthetic construct
MEKYYETFKNNEKITKTLSFSLVPVGKTGDWIKNNKVVEKDIDIAHKYQDAKQILDQYLRSITELILSENSARDLNINWIELFDKYRNVKTHRNDKEAFNEYYKSVGTIKEKIQNAFSGVSITSKDIIESAVKNGNCAGYPFTEDEIDILKAFVRFDGYFSKYNTSRNNIFKSGSSASIPYRCINDNFAKFGENILLFESLPPQVREKLKECCPVELFRPQSYDRYLCQAGVKEYNKAIGGYVNEDGSKIQGLNEILNECYQQKLLSKKRKFNMLFNQILSDKESLSFALEPFENDRDVLDAVSVVAGISMDYIKNRSDEIVELLEDESNHDDIYILDRNLNSFSSYLFSDFRYIRDQIKAKKGKPYTVGYIDECLPENIIDAFKTKYTGTVSEIISAYEPLNNILSRDSIEGYDEIKSFLDSVIALNQLLKTFSTTAKNKDGSVKENCEDRNVMFYSALDEMISVLSACTIIYNKVRNYATRKPYSTRKYKLNFDRGTLAAGWDITKEKDNSCIILNRGNEYYLGVYNKTFKGKLTCKAKQESGDYRKLYYKYLPSPMKMFPKVFFSGSWLKNHDCPLYIFRGYKEEKRYKPGENFDIDFLHDLIDYFKKCAKEYPNYEDFEFDFKETGDYNSLDEFYADVEKSNLFLKWDYVSNDEVNDLVDDGSLYLFRIYNKDFSGHSTGKPNNFTRYFLNLFTDENMVHPTFKLNGGGELFYRPKSIDNPFVHRKNSILFNKVTKEGKPLNGEMIELIYSKINGGAGIADLEMQYPDVKFKTARYDITKDKRYMEDKFLFHFSIDINSNAVTGKYNLNKEVVKKLSEDPNINIVGIDRGERNLLYMSVINQKGEILLQKSLNIINGIDYHAKLTQIENDRMRARKDWKTISKIADMQKGYLSWAINEIINTALEYNAIIILEDLNQGFNRFRRAISEKSVYTEFEKALISRLNYVAPKDKDVNNGYQLADMLDKVSDLSHINQTGIVFYVPAAFTSKIDPVTGFVNLFTKNEFDYRNRNSTLEFFRNFESIRYNEAEGYFEFSFKYSSFGLKQQDPQNDWTVCSTSGSRIVHTKVNGYDTKESLNVTEEFIQLFSDFGIDVKKEIVSQLDEIKDAEFFRKLLWLFKSLVQLRYEDDKEDYILSPIVRHGRCFDSREAKENEPIDGDANGAFHIALQGLRMFGRIDKETWKIKDEEQNKKRLNYLKYCQKELWKTR

SEQ ID NO: 785 - protein, 1370 aa, synthetic construct
MNGENRKGIFDDFTGKYSLSKTLRFELKPIGKTLENMRTQFGYDENLRTFLSDQNIEDAYQALKPIFDKIHEDFITESLESESVKSIKFSSYLDLYERKSDIKEKAFEVEEKKMRSAFGDAYIKVAESWKNVAGKTEKGKEIFSGSGFKILTEVGILEYIRKNADRFSDILSLDEIHKYLNIFEGFFTYFSGFNRNRENYYVTRDEKATAVATRIVHENLPIFCDNVLIFRGRQRVYEDIFESLRKLGDPLVMKGKDKKETPCISIDPNLFRIEYFTECLSQTEIESYNEAVGNANFLINRYNQAHGEKSEKLKFFKTLYRQIGCGRRDALFFELTDEKKSEAEKKRANQSKKKFYSLEELLHDVSEAGGRYFRASDRGDVSDIDVASLGSLPDLIAYIRSRENFTGFYWSKAAMNTISNRYFSDWHSLKDRLKTAKVFQDSVKGSQEDVRIPEAIDLEDFFTVLDSKPESLEEEWHWRDSGVFFKESLTETIECERKEDIDYEQCERRKKRNERYSSIVQNAQKPSRALLEMILSDIGEHVESFVRESGNIAHLSEYTSETSKEAIKSWLDEMLSATQMIKYFVVRPSKIKGEALDSVLAEYLKVFLDSEKDETNWFRYYDATRNFLTKKPQDDAKKNKLKLNFGQSTLASGWDMNKESDNLCVIFRDRDEKYFLGIISKRKEKGYNSLFKKQKENKLYVVEKGEIFSKMEYKLLPGPNKMLPKCLLPKSNRKKYGATDEILKIYDHGDFKKGSDGFSRESLGKIIDFYKSGLQKYEEWNCFDFSFRPTEEYVDISQFYLDVEKQGYKNSFVSVNKTVVDSWVSEGRLYLFEIHNQDSNSGKKEGHKNNLHTMYWDAMFRDIENRPKLNGEAEVFYRSALPEEKQQRADDNSGKSIIKNFRFSKEKFLFHVPITLNFCMKNRAVNREISEKLRDGAQCIFLGIDRGEKHLAYWSLVSEKGELLDQGSFNVVGGKDYNALLEARAGERDFARKNWKTIGTIKDLKEGYISQVVRKIVDIAVEKGALIVLEDLNIGFKRGRQKIEKQVYQKLELALAKKLNFLVDKSAKIGEIGSVTKAFQLTPPVNNFGDINSKQFGIMLYTRANYTSQTDPLTGWRKTVYLKRGSEESIKREILETFSDIVFDGKDYAFTYVEKIKVRIEKGKKKENNREIRNGKTWTLYSGKNGESLDRFRGKRGTDKNEWKVEKEDVVEMLDSLFANLDKKDRNRSLFTQMKGGGELVKISEYPAYESLRHCIDLIQQIRNTGEKENERDSDFLLSPVRNEHTGEHFDSRKYWDAEQRDEKLALPSSGDSNGAYNIARKGIVMAEHIRLGYKTYISDEEWSAWLSGESSWRKWIEENEKDLKWKEKK

SEQ ID NO: 786 - protein, 1370 aa, synthetic construct
MNGENRKGIFDDFTGKYSLSKTLRFELKPIGKTLENMRTQFGYDENLRTFLSDQNIEDAYQALKPIFDKIHEDFITESLESESVKSIKFSSYLDLYERKSDIKEKAFEVEEKKMRSAFGDAYIKVAESWKNVAGKTEKGKEIFSGSGFKILTEVGILEYIRKNADRFSDILSLDEIHKYLNIFEGFFTYFSGFNQNRENYYVTRDEKATAVATRIVHENLPIFCDNVLIFRGRQRVYEDIFESLRKLGDPLVMKGKDKKETPCISIDPNLFRIEYFTECLSQTEIESYNEAVGNANFLINRYNQAHGEKSEKLKFFKTLYRQIGCGRRDALFFELTDEKKSEAEKKRANQSKKKFYSLEELLHDVSEAGGRYFRASDRGDVSDIDVASLGSLPDLIAYIRSRENFTGFYWSKAAMNTISNRYFSDWHSLKDRLKTAKVFQDSVKGSQEDVRIPEAIDLEDFFTVLDSKPESLEEEWHWRDSGVFFKESLTETIECERKEDIDYEQCERRKKRNERYSSIVQNAQKPSRALLEMILSDIGEHVESFVRESGNIAHLSEYTSETSKEAIKSWLDEMLSATQMIKYFVVRPSKIKGEALDSVLAEYLKVFLDSEKDETNWFRYYDATRNFLTKKPQDDAKKNKLKLNFGQSTLARGWDMNKESDNLCVIFRDRDEKYFLGIISKRKEKGYNSLFKKQKENKLYVVEKGEIFSKMEYKLLPGPNKMLPKCLLPKSNRKKYGATDEILKIYDHGDFKKGSDGFSRESLGKIIDFYKSGLQKYEEWNCFDFSFRPTEEYVDISQFYLDVEKQGYKNSFVSVNKTVVDSWVSEGRLYLFEIHNQDSNSGKKEGHKNNLHTMYWDAMFRDIENRPKLNGEAEVFYRSALPEEKQQRADDNSGKSIIKNFRFSKEKFLFHVPITLNFCMKNRAVNREISEKLRDGAQCIFLGIDRGEKHLAYWSLVSEKGELLDQGSFNVVGGKDYNALLEARAGERDFARKNWKTIGTIKDLKEGYISQVVRKIVDIAVEKGALIVLEDLNIGFKRGRQKIEKQVYQKLELALAKKLNFLVDKSAKIGEIGSVTKAFQLTPPVNNFGDINSKQFGIMLYTRANYTSQTDPLTGWRKTVYLKRGSEESIKREILETFSDIVFDGKDYAFTYVEKIKVRIEKGKKKENNREIRNGKTWTLYSGKNGESLDRFRGKRGTDKNEWKVEKEDVVEMLDSLFANLDKKDRNRSLFTQMKGGGELVKISEYPAYESLRHCIDLIQQIRNTGEKENERDSDFLLSPVRNEHTGEHFDSRKYWDAEQRDEKLALPSSGDSNGAYNIARKGIVMAEHIRLGYKTYISDEEWSAWLSGESSWRKWIEENEKDLKWKEKK

SEQ ID NO: 787 - protein, 1370 aa, synthetic construct
MNGENRKGIFDDFTGKYSLSKTLRFELKPIGKTLENMRTQFGYDENLRTFLSDQNIEDAYQALKPIFDKIHEDFITESLESESVKSIKFSSYLDLYERKSDIKEKAFEVEEKKMRSAFGDAYIKVAESWKNVAGKTEKGKEIFSGSGFKILTEVGILEYIRKNADRFSDILSLDEIHKYLNIFEGFFTYFSGFNQNRENYYVTRDEKATAVATRIVHENLPIFCDNVLIFRGRQRVYEDIFESLRKLGDPLVMKGKDKKETPCISIDPNLFRIEYFTECLSQTEIESYNEAVGNANFLINRYNQAHGEKSEKLKFFKTLYRQIGCGRRDALFFELTDEKKSEAEKKRANQSKKKFYSLEELLHDVSEAGGRYFRASDRGDVSDIDVASLGSLPDLIAYIRSRENFTGFYWSKAAMNTISNRYFSDWHSLKDRLKTAKVFQDSVKGSQEDVRIPEAIDLEDFFTVLDSKPESLEEEWHWRDSGVFFKESLTETIECERKEDIDYEQCERRKKRNERYSSIVQNAQKPSRALLEMILSDIGEHVESFVRESGNIAHLSEYTSETSKEAIKSWLDEMLSATQMIKYFVVRPSKIKGEALDSVLAEYLKVFLDSEKDETNWFRYYDATRNFLTKKPQDDAKKNKLKLNFGQSTLASGWDMNRESDNLCVIFRDRDEKYFLGIISKRKEKGYNSLFKKQKENKLYVVEKGEIFSKMEYKLLPGPNKMLPKCLLPKSNRKKYGATDEILKIYDHGDFKKGSDGFSRESLGKIIDFYKSGLQKYEEWNCFDFSFRPTEEYVDISQFYLDVEKQGYKNSFVSVNKTVVDSWVSEGRLYLFEIHNQDSNSGKKEGHKNNLHTMYWDAMFRDIENRPKLNGEAEVFYRSALPEEKQQRADDNSGKSIIKNFRFSKEKFLFHVPITLNFCMKNRAVNREISEKLRDGAQCIFLGIDRGEKHLAYWSLVSEKGELLDQGSFNVVGGKDYNALLEARAGERDFARKNWKTIGTIKDLKEGYISQVVRKIVDIAVEKGALIVLEDLNIGFKRGRQKIEKQVYQKLELALAKKLNFLVDKSAKIGEIGSVTKAFQLTPPVNNFGDINSKQFGIMLYTRANYTSQTDPLTGWRKTVYLKRGSEESIKREILETFSDIVFDGKDYAFTYVEKIKVRIEKGKKKENNREIRNGKTWTLYSGKNGESLDRFRGKRGTDKNEWKVEKEDVVEMLDSLFANLDKKDRNRSLFTQMKGGGELVKISEYPAYESLRHCIDLIQQIRNTGEKENERDSDFLLSPVRNEHTGEHFDSRKYWDAEQRDEKLALPSSGDSNGAYNIARKGIVMAEHIRLGYKTYISDEEWSAWLSGESSWRKWIEENEKDLKWKEKK

SEQ ID NO: 788 - protein, 1370 aa, synthetic construct
MNGENRKGIFDDFTGKYSLSKTLRFELKPIGKTLENMRTQFGYDENLRTFLSDQNIEDAYQALKPIFDKIHEDFITESLESESVKSIKFSSYLDLYERKSDIKEKAFEVEEKKMRSAFGDAYIKVAESWKNVAGKTEKGKEIFSGSGFKILTEVGILEYIRKNADRFSDILSLDEIHKYLNIFEGFFTYFSGFNRNRENYYVTRDEKATAVATRIVHENLPIFCDNVLIFRGRQRVYEDIFESLRKLGDPLVMKGKDKKETPCISIDPNLFRIEYFTECLSQTEIESYNEAVGNANFLINRYNQAHGEKSEKLKFFKTLYRQIGCGRRDALFFELTDEKKSEAEKKRANQSKKKFYSLEELLHDVSEAGGRYFRASDRGDVSDIDVASLGSLPDLIAYIRSRENFTGFYWSKAAMNTISNRYFSDWHSLKDRLKTAKVFQDSVKGSQEDVRIPEAIDLEDFFTVLDSKPESLEEEWHWRDSGVFFKESLTETIECERKEDIDYEQCERRKKRNERYSSIVQNAQKPSRALLEMILSDIGEHVESFVRESGNIAHLSEYTSETSKEAIKSWLDEMLSATQMIKYFVVRPSKIKGEALDSVLAEYLKVFLDSEKDETNWFRYYDATRNFLTKKPQDDAKKNKLKLNFGQSTLARGWDMNKESDNLCVIFRDRDEKYFLGIISKRKEKGYNSLFKKQKENKLYVVEKGEIFSKMEYKLLPGPNKMLPKCLLPKSNRKKYGATDEILKIYDHGDFKKGSDGFSRESLGKIIDFYKSGLQKYEEWNCFDFSFRPTEEYVDISQFYLDVEKQGYKNSFVSVNKTVVDSWVSEGRLYLFEIHNQDSNSGKKEGHKNNLHTMYWDAMFRDIENRPKLNGEAEVFYRSALPEEKQQRADDNSGKSIIKNFRFSKEKFLFHVPITLNFCMKNRAVNREISEKLRDGAQCIFLGIDRGEKHLAYWSLVSEKGELLDQGSFNVVGGKDYNALLEARAGERDFARKNWKTIGTIKDLKEGYISQVVRKIVDIAVEKGALIVLEDLNIGFKRGRQKIEKQVYQKLELALAKKLNFLVDKSAKIGEIGSVTKAFQLTPPVNNFGDINSKQFGIMLYTRANYTSQTDPLTGWRKTVYLKRGSEESIKREILETFSDIVFDGKDYAFTYVEKIKVRIEKGKKKENNREIRNGKTWTLYSGKNGESLDRFRGKRGTDKNEWKVEKEDVVEMLDSLFANLDKKDRNRSLFTQMKGGGELVKISEYPAYESLRHCIDLIQQIRNTGEKENERDSDFLLSPVRNEHTGEHFDSRKYWDAEQRDEKLALPSSGDSNGAYNIARKGIVMAEHIRLGYKTYISDEEWSAWLSGESSWRKWIEENEKDLKWKEKK

SEQ ID NO: 789 - protein, 1370 aa, synthetic construct
MNGENRKGIFDDFTGKYSLSKTLRFELKPIGKTLENMRTQFGYDENLRTFLSDQNIEDAYQALKPIFDKIHEDFITESLESESVKSIKFSSYLDLYERKSDIKEKAFEVEEKKMRSAFGDAYIKVAESWKNVAGKTEKGKEIFSGSGFKILTEVGILEYIRKNADRFSDILSLDEIHKYLNIFEGFFTYFSGFNRNRENYYVTRDEKATAVATRIVHENLPIFCDNVLIFRGRQRVYEDIFESLRKLGDPLVMKGKDKKETPCISIDPNLFRIEYFTECLSQTEIESYNEAVGNANFLINRYNQAHGEKSEKLKFFKTLYRQIGCGRRDALFFELTDEKKSEAEKKRANQSKKKFYSLEELLHDVSEAGGRYFRASDRGDVSDIDVASLGSLPDLIAYIRSRENFTGFYWSKAAMNTISNRYFSDWHSLKDRLKTAKVFQDSVKGSQEDVRIPEAIDLEDFFTVLDSKPESLEEEWHWRDSGVFFKESLTETIECERKEDIDYEQCERRKKRNERYSSIVQNAQKPSRALLEMILSDIGEHVESFVRESGNIAHLSEYTSETSKEAIKSWLDEMLSATQMIKYFVVRPSKIKGEALDSVLAEYLKVFLDSEKDETNWFRYYDATRNFLTKKPQDDAKKNKLKLNFGQSTLASGWDMNRESDNLCVIFRDRDEKYFLGIISKRKEKGYNSLFKKQKENKLYVVEKGEIFSKMEYKLLPGPNKMLPKCLLPKSNRKKYGATDEILKIYDHGDFKKGSDGFSRESLGKIIDFYKSGLQKYEEWNCFDFSFRPTEEYVDISQFYLDVEKQGYKNSFVSVNKTVVDSWVSEGRLYLFEIHNQDSNSGKKEGHKNNLHTMYWDAMFRDIENRPKLNGEAEVFYRSALPEEKQQRADDNSGKSIIKNFRFSKEKFLFHVPITLNFCMKNRAVNREISEKLRDGAQCIFLGIDRGEKHLAYWSLVSEKGELLDQGSFNVVGGKDYNALLEARAGERDFARKNWKTIGTIKDLKEGYISQVVRKIVDIAVEKGALIVLEDLNIGFKRGRQKIEKQVYQKLELALAKKLNFLVDKSAKIGEIGSVTKAFQLTPPVNNFGDINSKQFGIMLYTRANYTSQTDPLTGWRKTVYLKRGSEESIKREILETFSDIVFDGKDYAFTYVEKIKVRIEKGKKKENNREIRNGKTWTLYSGKNGESLDRFRGKRGTDKNEWKVEKEDVVEMLDSLFANLDKKDRNRSLFTQMKGGGELVKISEYPAYESLRHCIDLIQQIRNTGEKENERDSDFLLSPVRNEHTGEHFDSRKYWDAEQRDEKLALPSSGDSNGAYNIARKGIVMAEHIRLGYKTYISDEEWSAWLSGESSWRKWIEENEKDLKWKEKK

SEQ ID NO: 790 - protein, 1370 aa, synthetic construct
MNGENRKGIFDDFTGKYSLSKTLRFELKPIGKTLENMRTQFGYDENLRTFLSDQNIEDAYQALKPIFDKIHEDFITESLESESVKSIKFSSYLDLYERKSDIKEKAFEVEEKKMRSAFGDAYIKVAESWKNVAGKTEKGKEIFSGSGFKILTEVGILEYIRKNADRFSDILSLDEIHKYLNIFEGFFTYFSGFNQNRENYYVTRDEKATAVATRIVHENLPIFCDNVLIFRGRQRVYEDIFESLRKLGDPLVMKGKDKKETPCISIDPNLFRIEYFTECLSQTEIESYNEAVGNANFLINRYNQAHGEKSEKLKFFKTLYRQIGCGRRDALFFELTDEKKSEAEKKRANQSKKKFYSLEELLHDVSEAGGRYFRASDRGDVSDIDVASLGSLPDLIAYIRSRENFTGFYWSKAAMNTISNRYFSDWHSLKDRLKTAKVFQDSVKGSQEDVRIPEAIDLEDFFTVLDSKPESLEEEWHWRDSGVFFKESLTETIECERKEDIDYEQCERRKKRNERYSSIVQNAQKPSRALLEMILSDIGEHVESFVRESGNIAHLSEYTSETSKEAIKSWLDEMLSATQMIKYFVVRPSKIKGEALDSVLAEYLKVFLDSEKDETNWFRYYDATRNFLTKKPQDDAKKNKLKLNFGQSTLARGWDMNRESDNLCVIFRDRDEKYFLGIISKRKEKGYNSLFKKQKENKLYVVEKGEIFSKMEYKLLPGPNKMLPKCLLPKSNRKKYGATDEILKIYDHGDFKKGSDGFSRESLGKIIDFYKSGLQKYEEWNCFDFSFRPTEEYVDISQFYLDVEKQGYKNSFVSVNKTVVDSWVSEGRLYLFEIHNQDSNSGKKEGHKNNLHTMYWDAMFRDIENRPKLNGEAEVFYRSALPEEKQQRADDNSGKSIIKNFRFSKEKFLFHVPITLNFCMKNRAVNREISEKLRDGAQCIFLGIDRGEKHLAYWSLVSEKGELLDQGSFNVVGGKDYNALLEARAGERDFARKNWKTIGTIKDLKEGYISQVVRKIVDIAVEKGALIVLEDLNIGFKRGRQKIEKQVYQKLELALAKKLNFLVDKSAKIGEIGSVTKAFQLTPPVNNFGDINSKQFGIMLYTRANYTSQTDPLTGWRKTVYLKRGSEESIKREILETFSDIVFDGKDYAFTYVEKIKVRIEKGKKKENNREIRNGKTWTLYSGKNGESLDRFRGKRGTDKNEWKVEKEDVVEMLDSLFANLDKKDRNRSLFTQMKGGGELVKISEYPAYESLRHCIDLIQQIRNTGEKENERDSDFLLSPVRNEHTGEHFDSRKYWDAEQRDEKLALPSSGDSNGAYNIARKGIVMAEHIRLGYKTYISDEEWSAWLSGESSWRKWIEENEKDLKWKEKK

SEQ ID NO: 791 - protein, 1370 aa, synthetic construct
MNGENRKGIFDDFTGKYSLSKTLRFELKPIGKTLENMRTQFGYDENLRTFLSDQNIEDAYQALKPIFDKIHEDFITESLESESVKSIKFSSYLDLYERKSDIKEKAFEVEEKKMRSAFGDAYIKVAESWKNVAGKTEKGKEIFSGSGFKILTEVGILEYIRKNADRFSDILSLDEIHKYLNIFEGFFTYFSGFNRNRENYYVTRDEKATAVATRIVHENLPIFCDNVLIFRGRQRVYEDIFESLRKLGDPLVMKGKDKKETPCISIDPNLFRIEYFTECLSQTEIESYNEAVGNANFLINRYNQAHGEKSEKLKFFKTLYRQIGCGRRDALFFELTDEKKSEAEKKRANQSKKKFYSLEELLHDVSEAGGRYFRASDRGDVSDIDVASLGSLPDLIAYIRSRENFTGFYWSKAAMNTISNRYFSDWHSLKDRLKTAKVFQDSVKGSQEDVRIPEAIDLEDFFTVLDSKPESLEEEWHWRDSGVFFKESLTETIECERKEDIDYEQCERRKKRNERYSSIVQNAQKPSRALLEMILSDIGEHVESFVRESGNIAHLSEYTSETSKEAIKSWLDEMLSATQMIKYFVVRPSKIKGEALDSVLAEYLKVFLDSEKDETNWFRYYDATRNFLTKKPQDDAKKNKLKLNFGQSTLARGWDMNRESDNLCVIFRDRDEKYFLGIISKRKEKGYNSLFKKQKENKLYVVEKGEIFSKMEYKLLPGPNKMLPKCLLPKSNRKKYGATDEILKIYDHGDFKKGSDGFSRESLGKIIDFYKSGLQKYEEWNCFDFSFRPTEEYVDISQFYLDVEKQGYKNSFVSVNKTVVDSWVSEGRLYLFEIHNQDSNSGKKEGHKNNLHTMYWDAMFRDIENRPKLNGEAEVFYRSALPEEKQQRADDNSGKSIIKNFRFSKEKFLFHVPITLNFCMKNRAVNREISEKLRDGAQCIFLGIDRGEKHLAYWSLVSEKGELLDQGSFNVVGGKDYNALLEARAGERDFARKNWKTIGTIKDLKEGYISQVVRKIVDIAVEKGALIVLEDLNIGFKRGRQKIEKQVYQKLELALAKKLNFLVDKSAKIGEIGSVTKAFQLTPPVNNFGDINSKQFGIMLYTRANYTSQTDPLTGWRKTVYLKRGSEESIKREILETFSDIVFDGKDYAFTYVEKIKVRIEKGKKKENNREIRNGKTWTLYSGKNGESLDRFRGKRGTDKNEWKVEKEDVVEMLDSLFANLDKKDRNRSLFTQMKGGGELVKISEYPAYESLRHCIDLIQQIRNTGEKENERDSDFLLSPVRNEHTGEHFDSRKYWDAEQRDEKLALPSSGDSNGAYNIARKGIVMAEHIRLGYKTYISDEEWSAWLSGESSWRKWIEENEKDLKWKEKK

SEQ ID NO: 792 - protein, 1370 aa, synthetic construct
MNGENRKGIFDDFTGKYSLSKTLRFELKPIGKTLENMRTQFGYDENLRTFLSDQNIEDAYQALKPIFDKIHEDFITESLESESVKSIKFSSYLDLYERKSDIKEKAFEVEEKKMRSAFGDAYIKVAESWKNVAGKTEKGKEIFSGSGFKILTEVGILEYIRKNADRFSDILSLDEIHKYLNIFEGFFTYFSGFNRNRENYYVTRDEKATAVATRIVHENLPIFCDNVLIFRGRQRVYEDIFESLRKLGDPLVMKGKDKKETPCISIDPNLFRIEYFTECLSQTEIESYNEAVGNANFLIARYNQAHGEKSEKLKFFKTLYRQIGCGRRDALFFELTDEKKSEAEKKRANQSKKKFYSLEELLHDVSEAGGRYFRASDRGDVSDIDVASLGSLPDLIAYIRSRENFTGFYWSKAAMNTISNRYFSDWHSLKDRLKTAKVFQDSVKGSQEDVRIPEAIDLEDFFTVLDSKPESLEEEWHWRDSGVFFKESLTETIECERKEDIDYEQCERRKKRNERYSSIVQNAQKPSRALLEMILSDIGEHVESFVRESGNIAHLSEYTSETSKEAIKSWLDEMLSATQMIKYFVVRPSKIKGEALDSVLAEYLKVFLDSEKDETNWFRYYDATRNFLTKKPQDDAKKNKLKLNFGQSTLASGWDMNRESDNLCVIFRDRDEKYFLGIISKRKEKGYNSLFKKQKENKLYVVEKGEIFSKMEYKLLPGPNKMLPKCLLPKSNRKKYGATDEILKIYDHGDFKKGSDGFSRESLGKIIDFYKSGLQKYEEWNCFDFSFRPTEEYVDISQFYLDVEKQGYKNSFVSVNKTVVDSWVSEGRLYLFEIHNQDSNSGKKEGHKNNLHTMYWDAMFRDIENRPKLNGEAEVFYRSALPEEKQQRADDNSGKSIIKNFRFSKEKFLFHVPITLNFCMKNRAVNREISEKLRDGAQCIFLGIDRGEKHLAYWSLVSEKGELLDQGSFNVVGGKDYNALLEARAGERDFARKNWKTIGTIKDLKEGYISQVVRKIVDIAVEKGALIVLEDLNIGFKRGRQKIEKQVYQKLELALAKKLNFLVDKSAKIGEIGSVTKAFQLTPPVNNFGDINSKQFGIMLYTRANYTSQTDPLTGWRKTVYLKRGSEESIKREILETFSDIVFDGKDYAFTYVEKIKVRIEKGKKKENNREIRNGKTWTLYSGKNGESLDRFRGKRGTDKNEWKVEKEDVVEMLDSLFANLDKKDRNRSLFTQMKGGGELVKISEYPAYESLRHCIDLIQQIRNTGEKENERDSDFLLSPVRNEHTGEHFDSRKYWDAEQRDEKLALPSSGDSNGAYNIARKGIVMAEHIRLGYKTYISDEEWSAWLSGESSWRKWIEENEKDLKWKEKK

SEQ ID NO: 793 - protein, 1370 aa, synthetic construct
MNGENRKGIFDDFTGKYSLSKTLRFELKPIGKTLENMRTQFGYDENLRTFLSDQNIEDAYQALKPIFDKIHEDFITESLESESVKSIKFSSYLDLYERKSDIKEKAFEVEEKKMRSAFGDAYIKVAESWKNVAGKTEKGKEIFSGSGFKILTEVGILEYIRKNADRFSDILSLDEIHKYLNIFEGFFTYFSGFNQNRENYYVTRDEKATAVATRIVHENLPIFCDNVLIFRGRQRVYEDIFESLRKLGDPLVMKGKDKKETPCISIDPNLFRIEYFTECLSQTEIESYNEAVGNANFLINRYNQAHGEKSEKLKFFKTLYRQIGCGRRDALFFELTDEKKSEAEKKRANQSKKKFYSLEELLHDVSEAGGRYFRASDRGDVSDIDVASLGSLPDLIAYIRSRENFTGFYWSKAAMNTISNRYFSDWHSLKDRLKTAKVFQDSVKGSQEDVRIPEAIDLEDFFTVLDSKPESLEEEWHWRDSGVFFKESLTETIECERKEDIDYEQCERRKKRNERYSSIVQNAQKPSRALLEMILSDIGEHVESFVRESGNIAHLSEYTSETSKEAIKSWLDEMLSATQMIKYFVVRPSKIKGEALDSVLAEYLKVFLDSEKDETNWFRYYDATRNFLTKKPQDDAKKNKLKLNFGRSTLASGWDMNKESDNLCVIFRDRDEKYFLGIISKRKEKGYNSLFKKQKENKLYVVEKGEIFSKMEYKLLPGPNKMLPKCLLPKSNRKKYGATDEILKIYDHGDFKKGSDGFSRESLGKIIDFYKSGLQKYEEWNCFDFSFRPTEEYVDISQFYLDVEKQGYKNSFVSVNKTVVDSWVSEGRLYLFEIHNQDSNSGKKEGHKNNLHTMYWDAMFRDIENRPKLNGEAEVFYRSALPEEKQQRADDNSGKSIIKNFRFSKEKFLFHVPITLNFCMKNRAVNREISEKLRDGAQCIFLGIDRGEKHLAYWSLVSEKGELLDQGSFNVVGGKDYNALLEARAGERDFARKNWKTIGTIKDLKEGYISQVVRKIVDIAVEKGALIVLEDLNIGFKRGRQKIEKQVYQKLELALAKKLNFLVDKSAKIGEIGSVTKAFQLTPPVNNFGDINSKQFGIMLYTRANYTSQTDPLTGWRKTVYLKRGSEESIKREILETFSDIVFDGKDYAFTYVEKIKVRIEKGKKKENNREIRNGKTWTLYSGKNGESLDRFRGKRGTDKNEWKVEKEDVVEMLDSLFANLDKKDRNRSLFTQMKGGGELVKISEYPAYESLRHCIDLIQQIRNTGEKENERDSDFLLSPVRNEHTGEHFDSRKYWDAEQRDEKLALPSSGDSNGAYNIARKGIVMAEHIRLGYKTYISDEEWSAWLSGESSWRKWIEENEKDLKWKEKK

SEQ ID NO: 794 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFRTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFEHSKLLGGFSESKTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKITLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 795 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFNTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFEHSKLLRGFSESKTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKITLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 796 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFNTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFEHSKLLGGFSESRTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKITLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 797 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFRTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFEHSKLLRGFSESKTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKITLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 798 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFRTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFEHSKLLGGFSESRTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKITLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 799 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFNTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFEHSKLLRGFSESRTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKITLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 800 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFRTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFEHSKLLRGFSESRTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKITLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 801 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFRTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIIAKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFEHSKLLGGFSESRTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKITLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 802 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFNTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFERSKLLGGFSESKTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKITLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 803 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFNTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFEHSKLLGGFSESKTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKILLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 804 - protein, 1304 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFNTRDNFYKTDGTSTAIATRIIKDNLQIFLENTVVFDKIKNKEINFSEVEKIFSIDVNLFFEINNFNNYFLQDGIDSYNKIIGGETLENGEKLKGLNEIINKYRQDTGEKIPYFKKLQKQILSEKSGNFIEEIENNDEFNDVLKKFYKNSLEKVQFLKDTFENLYNISDKNLEKIYFNKIAFNTISHKFGNAQEFEKIIYEEMKKEKVTGIKFDKKEEKYKFPDFIEIIFIKKALENHASENLFWKERYYKSEENKNGLLERNNKNLWEQFCKILNFEFLNILKRRIIDEAGEEYEVGFEISKNILGEKLENFDFNQENKGIIKDFADYSLTLYSFGKYFAVEKGRKWDLSIDTDDDFYDEYIEKFYENGYDEIVKPYNLMRNYISKKPWEDNKKWKLNFERSKLLGGFSESKTEKSDNGTQYGGYLFRKKEEDGKYTYYLGVSKNAKLFRRDDVFINVDQPTGYDRLHYRQVMTRSIYGSSYDGDFKKDKETLPEEKIIEKIKKSLENYTEIITDFNSLITKKGLSLQDIQKKIGDLVREKGIQSIYKPVSERQLSEANSTEDGFFLFQIHSKDIYLSTEQKNLHSLYLLEVLNNETSVFTLGTGEIFFQNKLEDKSLGRKKDKKGKEIINHKRFARDKILLHLSIVQNSGSSPIPNTEKGKRKFRNEFNQKINEFLANNPDINIIGIDRGEKHLAYFSVINQKGEIIESGSFNRIENYDKNGEKIAYPEREIKEIYQDGKLTDLELVETGKKVNYVDYKLLLEYKERKRLLQRQSWKEVEQIKDLKKGYISILVRKIADLIIKHNAIIVFEDLNFRFKQIRGGIEKSIYQQLEKALIDKLSFLVNKNEINPEKAGNILKAYQLAVPVDSLKQIGKQTGVIFYTEAAYTSKIDPITGWRPNLYLKKQNAEINKENILKFDKIVFNSEENRFEFTYDLKKFLGKDSKFPQKTVWTVCSSIERFKWNKFLANNHGDYDHYTNLTDGKLSNRELKEDEFSNFKELFKKYSIDINGNILEQIKNLKTKNNEKFFAEFINLFSLICQIRNTKKDVKGDENDFILSPVKPFFDSRNSKKFPKNGDDNGAYNIARKGLIILNRISENPEKPDLLIFNADWDNFARNI

SEQ ID NO: 805 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNRNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFENPNLAGGWSDGQEKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYFFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 806 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNQNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFENPNLARGWSDGQEKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYFFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 807 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNQNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFENPNLAGGWSDGREKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYFFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 808 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNRNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFENPNLARGWSDGQEKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYFFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 809 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNRNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFENPNLAGGWSDGREKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYFFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 810 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNQNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFENPNLARGWSDGREKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYFFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 811 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNRNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFENPNLARGWSDGREKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYFFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 812 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNRNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLIALYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFENPNLAGGWSDGREKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYFFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 813 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNQNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFERPNLAGGWSDGQEKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYFFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 814 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNQNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFENPNLAGGWSDGQEKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYLFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 815 - protein, 1359 aa, synthetic construct
MNNTTLQKFTNLYQLSKTLRFELKPVGKNGKQLSQGDTNEIFKKIIEQDRKIKEAYVALKPVLDKIHEDIINKSLSSEEAKKIDFALYFEEYKKGKEKKVDTFENTIRNELGKAFEKTANNFAESVGEGKGIPIFKKNKGKHVGVAYLTQSGILKYIEKNIKLLVTESEIKEFIDEKEITNTKGKKEIKRTGHLVVLSSFFTYFSGFNQNRENYYVTKEEKATAVATRIVHENLPKFCDNAVQFYGSRKEEYLGALEFLKNNNRTTKIKDAETNTMIDAKAIVEDWFNIERFSTCLAQSEIEGYNKVIGHYNLLINLYNQAKKTEDKSFKNLQPFKTLFKQIGCGEKKALFFELKFDTKEEQQKANENSDAPLNLQETIELISKAGKKYFQKSTNDSDVTIYSLIDWLKNNTDWNGVYWSKSAVDKVSNKYFANWHEIKDRIQKVLESKEKEQKELLRSVASFDKKREEQLKINDAVELSILFSVLNQTSEESWSKSFFKESILSDRSSVIDEKLSPSENVINLICSDLQDLATDFFSKSVAVLKITDYKHEDNILAIKEWLDTAKYILWLIKYFEVKAVKVKGNNINPELTVLLDSILRANDADWLDWYDLVRNYLTKKPQDDAKKNKLKLNFERPNLAGGWSDGQEKNKGTVLLKNNDRYYLGVLISRSVFDTEKEENPIYKASDSNIGRLILKTLKFQTLAGKGFIRDYGIKYGDIQQDDDAIQKLQGFIKNNYVKKYPLLKEVSEKKYDNKKAFDKDIQDALSKCYECNYRPVNWNVILKNVADEEIYLFEIYSKDFSNKSTGTPNLQTKYWKHLFDDDSSIQLCGGGELFFREKVELKAEDKAIHPANEKIYRRSDGKKESIFKHDIVKNKRFINNKYLFHVPIKINYQAPSPKQARVNDVVNDNFTKVNDIQFLGIDRGEKHLIYYSLLDANGNIKENGQGHFDIINKKNYLQEINDAAKKRKEKQENWQQKGNIANLKDGYISLVVHEIIQKMKDEKGNLKPTFIVLEDLNTGFKRSRQKFEQSVYQKFELALAKKLNYLVDKNANDGEISSVAKALQLTPPVSNYGDIENRKQVGVMLYTRANYTSITDPVTGWRKTIYLKKGSEDVIKTEIFKTFDNIGVDNHGDYFFEYKDESTQKTWILRSGEKGKTLERYRAKRAKDKNEYIVESIDVKSLLDKLFEKFDKSKSLKQQLQEGKELPKINEHTAWETLRFIIDIIQQIRNSGDTSKGQDDNFLQSPVRNEQGVHFDSRLFEKQENPKLPKDADANGAYNIARKGIVMYEHIKQWVNDGKHKFEKGNDLDLFISDKEWDLWVSDKQKWGNEVKSFASKKAKESNTKKITVKTEMVVANE

SEQ ID NO: 816 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNRNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLNANLLGGWSDGEEKNKGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFFFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 817 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNTNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLNANLLRGWSDGEEKNKGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFFFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 818 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNTNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLNANLLGGWSDGEEKNRGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFFFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 819 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNRNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLNANLLRGWSDGEEKNKGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFFFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 820 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNRNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLNANLLGGWSDGEEKNRGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFFFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 821 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNTNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLNANLLRGWSDGEEKNRGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFFFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 822 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNRNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLNANLLRGWSDGEEKNRGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFFFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 823 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNRNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLIALYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLNANLLGGWSDGEEKNRGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFFFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 824 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNTNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLRANLLGGWSDGEEKNKGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFFFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 825 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNTNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLNANLLGGWSDGEEKNKGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFLFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 826 - protein, 1333 aa, synthetic construct
MKNFVNKYSLSKTLRFELKPVGSNGKLLNEDEATEIFKKIIEQDRKVKAAYTALKPVIDKIHEDIINTSLTSEEVKQIGFADYFEEYKKGKAKMLNDFEKSLREQIGKAFEDVLKSYAVKKISKKKEEEEKSVFEFKKSVPIAKAEIIDYLLEQHNDDANLVTHIKEFKGFFGYFKGYNTNRANYYEYKKEADTSVATRIIHENLPKFCDNAIQFESKKDDYTGAYQFLKANSQTTQIKDAETNAMIEAEAISEDWFKIEKFSECLTQNGIDAYNRVIGHYNLLINLYNQARNDEKDFRKIPQFKTLFKQIGSAKRVLFEQIESDEELKAQLETLSNAGGKYFKESTDINQITIQSFTKWLKENDDWDGVYWSKAAVDKISNKYLANWHEIKDRIQTILQGKDKEQKDSLKSVATYKKNREEELKINDAVELSGLFKILNQQIGKDSSKAFFKQSVLEEQQSLIDENKTPSQNLINLICCEIELHANNFNGNSTAIFEIKDYKNEENIKTIKDWLDFTKQILWSVKYFDVKQNKIKGNSPNSELSNILSTFLRNDNTDWFNWYDLVRNYLSKKPQDDAKKNKLKLNFLRANLLGGWSDGEEKNKGAVLLKNVNKKYVGILIERNIFDTKKKKNPVYSESATDTGRLILRNLAFKTLTGKGFNGMFNGQKYSDIGKTNPLGAIYNLQKFISEYVIKKDKITYAEKYPLLKNVLEKKYTDKKTFDKEVQDTLTQCYENDFVPINWREVLKFVEQEKMYLFEIYSKDFSETKGEKSKNSNVNLQTKYWEHIFQKNSTIQLNGGGEIFFRGKVDLKEEDKAIHPANEKINRRSDGKKESIFKHEIIKNKRFTTEKFLFHIPIKINYQEPSYVYQGKVKDIVSPIVNDEFSKSSDIQFLGIDRGEKHLVYYSLVNKNGEILSQGHFDTINNKNYLDEINNAAKKRKEKQENWQQKGNISNLKDGYISLVVHEILEKMKDKEGNYKPTFIVLEDLNPGFKRGRQKFEQQVYQKFELALAKKLNYLVDKKASIGAIGSVPKALQLAPPVSNYGEIENKKQVGIMLYTRANYTSVTDPATGWRKTIYLKTGSEEDIKKQILNSFTEIGIENNDYYFQYTDANGKEWKLWSGKDEKSLERYRFKRGNSKNEPTIESYDVKALLDKLFEKFDKTKPLKQQLESGIELTKVNEHTAWETLRFVIDIIQQIRNSGDTTKKQDDNFLQSPVRNDEGNHFDSKNFKDVDNAKLPKDADANGAFNIARKGIVMYEHIRGLGKNWNKKVKIDGNETIDLDLFVSDQEWDLWLTNREQWQNKLAHFSSRSAKEESKVISNKKIIDEENEN

SEQ ID NO: 827 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNRNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGKGDFLNGFVDSHTKKKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYIFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 828 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNTNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGKGDFLRGFVDSHTKKKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYIFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 829 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNTNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGKGDFLNGFVDSHTKRKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYIFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 830 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNRNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGKGDFLRGFVDSHTKKKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYIFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 831 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNRNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGKGDFLNGFVDSHTKRKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYIFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 832 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNTNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGKGDFLRGFVDSHTKRKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYIFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 833 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNRNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGKGDFLRGFVDSHTKRKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYIFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 834 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNRNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLIALYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGKGDFLNGFVDSHTKRKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYIFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 835 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNTNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGRGDFLNGFVDSHTKKKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYIFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 836 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNTNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGKGDFLNGFVDSHTKKKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYLFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 837 - protein, 1399 aa, synthetic construct
MNKVDSEKLTGLYSLSKTLRFELKPEPATKERFDKWLKEIEGKTEDGDEIFVEYDENNMFGKDVKIANAYKVLKTVLDKIHEEFITKSLSSDIAKKIDFSEYYNTCNNDKKKARENLEKTLRDKVGETFSEGKKYFSEEIGNVIKKKESKSKKKKESYGILDNEVFDYIKENVDKYASEDISKEKLNECLEIFKDFHTYFKGYNTNRSNYYEKKEQSTAVATRIVHENLPKFCNNAIRFEKRKDDYIAIYNLLKEQGKETILKNEDGEEVEAIPITEDIFQITHFNKCLTQKEIEDYNKIIGNYNLLINLYNQNRRNEKGFEKLDEFETLYKQIGCGKRKSFIISLQKDKESELEYKEKNSDDILSVEKLLKTALSAGEKVFKESENNYAVTLPKFIAFLKEKNESNNWSGIYWSGNAIDSLSTKYFTNWHTIKDLLKGNKGCTKKCTSQDEDTVQLLEAVELSDLFSVLNSVGTEYVFKNYLIENKSVNKDLSVSVNLINLLCNEIENKTKLFLDKANKVIDLKCYKDKKVLNDEEDENVNQVDEWFKYATNSMAIVRYFSVRKNKIKGSLPDTEMENMLNSLLHNDKYNWFRWYDLLHNYLSKKPQDDVKDNMLKLNFGRGDFLNGFVDSHTKKKDGTQYGGYIFRKKHLISGEYEYYLGISNNDKLFRCHLKNEVKEDDKSDYERLEYYQIGAKNIYRNGYKEKKKLIQKLVKELTYTKTEEERDESERINKTNPKGEITPLELFKRLSESEYFKEVLNNNQLLEVVNDTINLLVDNCKNYTRLNSLERIVSNEYVGFEGLKSLINDIEEITSKNKTFLFFNVSSEEFDKHNGEDLFLFKIANKDLSYSETYSKGIRRKRTTEKENLHTLFFRALMHEDGFADCVDIGSGEIFFRKKAFEYDKKTLERGHHAEELKGKFSYPIISNKRFSEDKYLFHLSVTLNYKDGNQNDDGINSVVNDVFQKAEVLNFIGIDRGEKHLVYSCIIDSNGKIVDNGCKHYDVINGTNYVEKLEVRADERDKARKNMQRVKNISNLKDGYISHVVHGLTNTIIKDKEGNINPHAYIVLEDLSRGMKDSRQKIEKQVYQKLETALAKKLNFVVDKEAKNGEIGSVGKALQLTPPFGTYQDIEGKKQFGVMLYTRANYTSVTDPATGWRKTIYLKNGKIDGIKEQIMDKFTDFGFDGKDYYFTYKENNVGKEWVMYSGKDGVSLPRFQNKKSAQTDYDIWIPEQVDIVGMLNKIFEGFDKTKSFKDQIIKDGREINKLDGRNETAWQSLVYVINVIQQIRNSGKNEKDEKDDNFLYSPVRNEKGEHFDTRNHINNGDLAQIVDADANGAYNIARKGLIMHEHIKYAKGKGKEPDLFISDREWDMWLLNREEWEKYLPEFALRKESKSKK

SEQ ID NO: 838 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHRNRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFENSTLMDGWDVNKETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFQFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 839 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHENRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFENSTLMRGWDVNKETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFQFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 840 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHENRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFENSTLMDGWDVNRETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFQFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 841 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHRNRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFENSTLMRGWDVNKETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFQFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 842 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHRNRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFENSTLMDGWDVNRETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFQFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 843 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHENRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFENSTLMRGWDVNRETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFQFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 844 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHRNRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFENSTLMRGWDVNRETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFQFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 845 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHRNRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYIALFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFENSTLMDGWDVNRETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFQFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 846 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHENRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFERSTLMDGWDVNKETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFQFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 847 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHENRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFENSTLMDGWDVNKETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFLFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 848 - protein, 1240 aa, synthetic construct
MKESLSHFSGLYSLSKTLRFELIPQGKTLDYIQKNGLLSQDEHRADSYKLVKKIIDEYHKAFIEQALDGLELNLLEEYYLYYQIQKKEDSQKKQFEDIQTKMRKQISDKLTKNEKFKNLFGKELIKDDLQVFVQNVEERELVKEFENFTTYFTGFHENRKNMYSDEEKSTAIAFRLIHQNLPKFIDNMRAFDKIRMSNLKEKFSHILSNSELGPIIQVLTIEDVFSLQYFNQTLTQIGIDKYNQLIGGYTSEDGATKIKGLNEYINLFNQNVKDKNQKLPKLKTLFKQILSDRSTASFIPQQYEDDNAVLESIEKLYQELNEHVFSKQIKGEHSLIELLQNLPEYDLSKIYVRNDTSLTDISQKLYGDWSVIQKALYIDYDQHYTGKKKLGTEQYEEERKKNLKQDSYSIAYINSCLSLLPKEIELKNIETYFALLGKTETEPTLFDTLTKNYQEIKDLLNTPYPDNKNLAQQQVDVEKIKALLDSIKSIQWFIKPLLGKGNEAEKDERFYGEFASLWEVLDQITPIYNKVRNYMTRKPYSTEKIKLNFERSTLMDGWDVNKETDNTSILFKKDGLYYLGIMNKKHNKVFKKDFDPKDTAVFEKMEYKLLPGANKMLPKVFFSNSRIDEFKPSDKLLENYKNETHKKGDNFNIQHCHELIDFFKSSINKHEDWKKFGFQFSDTQSYQDLSGFYREVEQQGYKLSFKAIPQSYIYELVDEGKLYLFQIFNKDFSPYSKGTPNMHTLYWKMLFDEQNLKDVVYKLNGQAEVFYRKASIKNENIVVHKANEAIKNKNEANEKKHSNFNYDLVKDKRYTVDKFLFHVPITMNFKGRGLNNINLEVNEHIRNNEDIHIIGIDRGERHLLYLTLIDGKGNIVEQYSLNEIINEHKGNKYTTNYHTLLDAREGNRNEERRNWKTIESIKELKEGYLSQVIHKISELMVKYNAIVVLEDLNAGFIRGRQKVEKSVYQQFEKMLIDKLNYLVDKKKSATELGGTLKALQLTNKFESFQKMGKQSGFLFYVPAWNTSKIDPVTGFVNFLDTKYENIDKTKTFFKKFKDIRYNSEKGYFEFVIDNYTQFNPKAEGTRQNWTICSYGTRIETFRNADKNNQWDNREINITAEFMKLFGNTTRISEMISQQNDKSFFERLMHLLKLTLQMRNSITNTEIDYLISPVADENGVFFDSRNIDINAGKPMNADANGAFNIARKGLWVIQQIKNPATDLKKIKLAITNKEWLQFVQS

SEQ ID NO: 849 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHRNRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQNSTLLKGWDVNKERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYQFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 850 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHENRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQNSTLLRGWDVNKERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYQFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 851 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHENRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQNSTLLKGWDVNRERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYQFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 852 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHRNRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQNSTLLRGWDVNKERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYQFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 853 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHRNRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQNSTLLKGWDVNRERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYQFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 854 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHENRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQNSTLLRGWDVNRERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYQFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 855 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHRNRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQNSTLLRGWDVNRERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYQFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 856 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHRNRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYIALYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQNSTLLKGWDVNRERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYQFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 857 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHENRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQRSTLLKGWDVNKERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYQFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 858 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHENRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQNSTLLKGWDVNKERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYLFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 859 - protein, 1234 aa, synthetic construct
MANFEDFTNLYSISKTLRFELKPIGKTKDNIEKNGLIEEDNRRADSYKKVKKIIDEYHKDFIEKSLSSCKLKIESNDKKDSLEEYCELYKKKDKSESDKNTLKKIQDQLRNQIVKGFKDREEFKNLDKKELITELLPKFLDNENKKELVEEFNSWTTYFTGFHENRKNMYSNEEKSTAIAYRLIHENLPKHLDNVAIFEKLKTSNVSEDFATLSKDLKEELQGKSLEDFFLIESYAKLLSQSQIERYNALIGGKSLEDNKKIKGLNEYINLYNQKQKDSKDRLPKLKMLYKQILSDRGALSWLPETFSSDNELLEKIEECRREFTTNEDGKGSLLEKIKQLITSLDKYDISKIYIRNDVQITNISQKAFGGYGIIYAGLRNLLKKDTPQKKKENNEDYEERLEKLIKALDSIAISTIEEEVASLGLENKSSIVDYFKQNIETLFVDIENNYSKVKDLLNIEYPKDENLKQDKVNVEKIKNYLDSLKALQNYIKPLCGKGNEAEKDEKFYGDFTLLWDEFNKITQLYNMVRNYLTQKPYSDKKIKLNFQRSTLLKGWDVNKERDNTSVLLRKDGLYYLAIMNKEYNGVFEAKNTKDKNNGEYYEKIEYKLLPGPNKMLPKVFLSKKGIEEFNPSEELLKNYHNETHKKGDKFKIEDCHALIDFFKTSIEKHKDWKHFGFVFSDTKSYEDLSGFYREVEHQGYKITFRNIAVDYIDSLVEEGKIYLFQIYNKDFSPHSKGTPNLHTLYWKMLFEGDNLSNVVYKLNGEAEVFFREKSLPNDKPTHPANEPIEHKNKLSGDYKSVFPYDLIKDKRYTVDKYLFHVPITINFKSENINFINDRTNQYIRESKDLHIIGIDRGERHLLYISVVDLQGNIKYQTSLNVINNYDYHDKLTEREKERDEERKSWQTIEGIKDLKEGYLSQAIHKICNLMIEYNAIVVLEDLNFGFMRGRQKFEHSVYQKFEKMLIDKLNYLADKKKKPQEIGGLLKAYQLTNQFKSFKELGKQSGFLFYTQAWNTSKIDPVTGFVNLFDTRYTNKENARKFFSNFEDIRFNKEKNYFEFEFDYNNFTTKAEETRTKWTVCTYGERIETFRNPEKNSQWDNGEIDLTQSFKTLFEEKKIDIKNLKTEIEKQDDKEFFEKLLHLFRLTLQLRNSITDTNTDYILSPVADENGNFYYSNTAPDSLPQDADANGAYNIARKGIMIVERIKASKKGEKLDLAISNKDWLKFAQGIKQ

SEQ ID NO: 860 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHRNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLNGWDANKEADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 861 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHQNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLRGWDANKEADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 862 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHQNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLNGWDANREADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 863 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHRNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLRGWDANKEADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 864 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHRNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLNGWDANREADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 865 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHQNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLRGWDANREADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 866 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHRNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLRGWDANREADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 867 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHRNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIIALYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLNGWDANREADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 868 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHQNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFERAQLLNGWDANKEADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFQFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 869 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHQNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFENAQLLNGWDANKEADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFLFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 870 - protein, 1276 aa, synthetic construct
MTALLQNFTNQYQLSKTLRFELIPQGKTFDFIQEKGLLNQDKRRAESYQEMKKTIDKFHKYFIDLALSNVKLTHLDAYLELYNTSAETKKESKFKDDLKKVQDNLRKEIVKSFSEGEAKSIFAILDKKELITVELEKWFESNEQEEIYFDDKFKTFTTYFTGFHQNRKNMYSVEANSTAIAYRLIHENLPKFLENAKAFEKIKQVPELQPKIAKIYKEFESYLNVNSIDELFELDYFNDVLTQMGIDVYNNIIGGRTESDGKSKIQGLNEIINLYNQTKEKNQRLPKLKQLYKQILSDRISLSFLPDAFTDGKQVLKAIFDFYKINLLSYTIEGQEESQNLLLLISQIVENLSGFDNQKMYLRNDTHLTTISQQLFGDFSVFSTALNYWYETKVNPKFEAEYSKANEKKREALDKTKANFTKQDYFSIAFLQEVLANYVLTLDKTSDVVQKFTPTCVADYFNNHFVAKKENETDKTFDLIANITAKYQCIQGILENADRYEDELKQDQKLIDDLKFFLDAIMELLHFIKPLHLKSESITEKDTAFYDVFENYYEALSLLTPLYNMVRNYVTQKPYSTEKIKLNFERAQLLNGWDANKEADYLTTILKKDGNYFLAIMDKKHNKAFQKFPEGTDNYEKMVYKLLPGVNKMLPKVFFSNKNIAYFNPSKELLENYKKETHKKGDTFNLEHCHALIDFFKDSLNKHEDWKHFDFQFSETKSYQDLSGFYREVEHQGYKINFKNIDSEYIDGLVNEGKLYLFQIYNKDFSPYSKGKPNMHTLYWKALFEEQNLQNVIYKLNGQAEIFFRKASIKPKNIITHKANQPIKAKNPLTPEAKNTFEYDLIKDKRFTVDKFLFHVPITMNFKATGGSYINQTVLEYLQNNPEVKIIGLDRGERHLVYLTLIDQQGNILKQESLNTISDTKIATPYHKLLDNKEKERDLARKNWGTVENIKELKEGYISQVVHKIATMMVEENAIVVMEDLNFGFKRGRFKVEKQIYQKLEKMLIDKLNYLVLKNKQPHELGGLYNALQLTNKFESFQKMGKQSGFLFYVPAWNTSKIDPTTGFVNYFYTKYENVEKAKAFFDKFQSIRFNTRANYFEFEVKKYSDFNPKAEDTKQEWMICTFGERIETKRQKDQNNNFVSTTINLTEKTEDFFGKNNIVYGDGNCIKKQIAAKEDKDFFETLLYWFKMTLQMRNSVTGTDEDYLISPVMNADGIFYDSRKADNNLPKDADANGAYHIAKKGLWILEQINKPKTTEELKKIKLAISNKEWLQYVQE

SEQ ID NO: 871 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHRNRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNKEQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 872 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHENRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMRGWDLNKEQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 873 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHENRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNREQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 874 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHRNRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMRGWDLNKEQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 875 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHRNRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNREQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 876 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHENRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMRGWDLNREQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 877 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHRNRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMRGWDLNREQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 878 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHRNRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYIALYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNREQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 879 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHENRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFERSTLMNGWDLNKEQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 880 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHENRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNKEQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFLFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 881 - protein, 1287 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQIAKRFSDDDRFKRIDKKELIKEDLLSFVEDVEKRQLIEEFKDFTTYFTGFHENRKNMYTDEAQSTAIAYRLIHENLPKFIDNIMVFDKVAASPIAKYFAELYSDFEEYLNVSELGEMFRLDYYNIVLTQTQIDVYNAVVGGRTLDDGTKIQGLNEYINLYNQQQKDKSARLPKLKPLYKQILSDRNAISWLPEQFQSDEKVLEAILKAYQELDEQVLNRKKEGEHSLKELLLSLSNYDLTKIYIRNDTQMTDISQKAFGHWDVIPKALLEQLKKEVQKKSKESEEAYEERLNKIIKSQGSIPIALINQGVQKQNSEEQNTLQTYFASLGAVETESVKKENLFTQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFERSTLMNGWDLNKEQDNTTVILRKDGIYYLAIMDKKHKKVFDEKNILGSGECFEKMEYKFFKDLTTMVPKCTTQLKVVKEHFLTHSEPYTISKDVFYSKFEITKEEYELNNVLYNGKKKFQKDYLRQTGDEKGYKDALTKWIRFCLRFLAQYKSTMIYDISSFQVDCKINSYTSIDEFYSEINLYLYNITFRNVSVDYINSLVEEGKIYLFQIYNKDFSPYSKGTPNLHTLYWKMLFDEKNLADVVYKLNGQAEVFYRKSSIICERPTHPANQAINNKNVLNKKKHSTFVYDLVKDKRYTVDKFLFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKVGKQSGFLFYTQAWNTSKIDPVTGFVNLFDTRYETREKAKDFFGKFDAIRYNTAKDWFEFAFDYSNFTSKAEGSRTNWTLCTYGERIEKFRDEKQNSNWASRGINLTDKFKELFAEYKIDIQTDLKEVISRQDSADFFKRLLYLLKLTLQMRNSETGTEVDYMQSPVADANGNFYNSETCDDSLPKNADANGAYNIARKGLWIVQQIKATDDLKNVKLSISNKEWLKFAQEKPYLNE

SEQ ID NO: 882 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHRNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLGGWDVNKEPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 883 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHQNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLRGWDVNKEPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 884 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHQNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLGGWDVNREPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 885 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHRNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLRGWDVNKEPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 886 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHRNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLGGWDVNREPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 887 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHQNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLRGWDVNREPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 888 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHRNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLRGWDVNREPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 889 - protein, 1254 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHRNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVALYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLGWDVNREPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 890 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHQNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDRAQLLGGWDVNKEPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFQFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 891 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHQNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDNAQLLGGWDVNKEPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFLFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 892 - protein, 1255 aa, synthetic construct
MKEKEQYSDFSRLYPVSKTLRFELKPIGRTMKNIEKNGILERDNQRANDYKIVKEFIDEYHKQHIKDRLWDFKLPLKSDGRLDSLKEYQELYELSKRDANQESAFTEIKDNLRSIIARRLTHDSPAYKRIDKKELIREDLLEFLENEEDKEIVRQFADFTTYFTGFHQNRQNMYTAEEKSTAIAYRLIHQNLPKFMDNMKAFAKIAETSVAEHFADIYEGWKEYLNVGSIEKIFQLDYFSETMTQPHIEVYNYIIGKKILEDGTEIKGINEYVNLYNQQQKDKSQRLPFLVPLYKQILSDREKLSWMAEEFDSDEKMLAAINESYVHLHDLLMGTENESLRSLLSHMKDFNLEQININNDLSLTDISQHLFGRYDVFTNGIKDELRAITPRKKKESDEDFEDRISKIFKTQKSFSISLLNKLPQPVMEDGKPRTVEEYFMSLGAVNTETTQKENLFAQIENAYENARSILQMKDTGDALSQNKQAVAKIKALLDAFKDLQHFIKPLLGSGEENEKDELFYGVFQLIWDELDTMTPLYNKVRNWLTRKPYSTEKIKLNFDRAQLLGGWDVNKEPDCTGVLLQKDGFYYLGIMNKKANRIFESKVTPSNEDCYEKIDYKLLPGANKMLPKVFFSKSRIDEFAPSEAIVDSYRRGTHKKGPDFNLSDCHRLIDFFKDSIAKHEDWSKFVFHFSETSTYEDISGFYREVEQQGYMLASHPVSVSYVEQMVDEGKLYLFRIWNKDFSEHSKGTPNLHTLYWKMLFDERNLADVVYKLNGQAEVFYRRASIKPKNRIIHQANSPIANKNELNEKRTSTFKYDIIKDRRYTVDKFLFHVPITIGFKAIGQNNINPIVQDTIRQGGFTHIIGIDRGERHLLYLSLIDLKGNIIKQMTLNDIVNEYNGVLYKTNYRDLLKKREGERTDARRSWETIETIKELKEGYLSQVVHIISKMMVEYNAIIVLEDLNTGFMRGRQKIERQVYEKFEKMLIDKLNCYIDKQTNPEDVGGLLHPLQLTCDAQKWKRSHQCGCLFYIPAWNTSKIDPVTGFVNLFDTRYETREKARLFFSKFQRIDFNTESDWFEFSFDYNDFTTKAEGTRTKWTLCTYGERIRTFRNPEKNHQWDDERIVLTDEFTQLFERYNIDIQGNLKEAISAQSDAQFYRELLGLMKLLLQMRNSITNSEEDYLLSPVADESSHFFDSRENVEILPNNADANGAYNIARKGLWVIRRIQETAENEKISLAISNKEWLQFAQTQPYLND

SEQ ID NO: 893 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHRNRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDNSQLLGGWDVNKEPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFQFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 894 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHENRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDNSQLLRGWDVNKEPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFQFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 895 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHENRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDNSQLLGGWDVNREPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFQFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 896 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHRNRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDNSQLLRGWDVNKEPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFQFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 897 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHRNRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDNSQLLGGWDVNREPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFQFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 898 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHENRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDNSQLLRGWDVNREPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFQFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 899 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHRNRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDNSQLLRGWDVNREPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFQFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 900 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHRNRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVALYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDNSQLLGGWDVNREPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFQFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 901 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHENRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDRSQLLGGWDVNKEPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFQFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 902 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHENRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDNSQLLGGWDVNKEPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFLFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 903 - protein, 1249 aa, synthetic construct
MKNLKQFTGLYPVSKTLRFELQPIGKTKENIEKNGILSRDEKRAEDYKIVKTFIDEYHKQFIKERLWGFTLPLISEGHLDSLEEYQSLYEMSKRNDSQEAEFSEVKDNLRSIIAKRLTESGSAYERIFKKELIREDLIDFLEKEGDKEIVRQFADFTTYFGGFHENRKNMYSAKEKSTAIAYRLIHQNLPKFMDNMKAFTKIAETSVAEHFADIYEGWKEYLNVGSIEEIFRLDYFSETLTQPHIEVYNYIIGKKILEDGTEVKGINEYVNLYNQQQKDKSQRLPFLVPLYKQILSDREKLSWLTEEFDSDDKMLTAINELYAHLHDLLMSDENDSLRSLLIHIKDFNLTQINITNDLSLTDISQHLFCRYDVFTNGIKDELRKITPRKKRESDEDFEDRISKIFNTQKSFSINFLDKLPQPVMEDGKPRSIADYFMTLGAVNTQTTQKENLFAQIENAYEEARAFLQMKDTGNALSQNKPAVAKIKSLLDALKDLQHFIKPLLGSGEENEKDELFYGSFQMMWDELDTITPLYNKVRNWLTRKPYSTEKIKLNFDRSQLLGGWDVNKEPDCTGVLLRKDGLYYLGIMDKRANHIFEADVTPKDGDCYEKMVYKQLGQISQQLPRIAFSKSWQQKISTSEDVIRIKKTESFKKNNDDLQKLISYYKSFISQHDEWNNYFNIKFSNRSNYKNLPDFYSEVDTQFYTLLLSKVSVSYINQLVNEGKLYLFRIWNKDFSEFSKGTPNLHTLYWKMLFDERNLTDVVYKLNGQAEVFYRKASIQPENKVIHQANKPIDNKNELNEKRTSTFEYDIIKDKRYTVDKFLFHVPITINFKAIGQTNINPIVQDAIKQGDFSHIIGIDRGERHLLYLSLIDLKGNIVKQMTLNDIVNEYKGQTYKTNYHYLLAKREGERTDARRSWETIETIKELKEGYLSQIVHIISKMMVEYNAIVVLEDLNTGFMRGRQKIERQVYEKFEKMLIEKLNCYIDKHTDPSDNNGLLHPLQLTCESKNWKRSHQCGCLFYIPAWNTSKIDPVTGFVNLLDTRYDTREKARVFFSKFQRISFNAEKGWFEFALDYNDFTTKAEGTRTQWTLCSYGERIRTFRNPQRNHQWDNERVVLTDALKQLFDKYNIDIYGNIKEAISAQTDAQFFKELLGLMKLMLQMRNSITNSEEDYLMSPIADNAGHFFDSREGISSLPIDADANGAYNIARKGLWVIRKIQETSDGAKPSLTITNKEWLQFAQTKPYLND

SEQ ID NO: 904 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYRNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDTPTLLNGWPDAQASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFQFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 905 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYDNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDTPTLLRGWPDAQASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFQFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 906 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYDNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDTPTLLNGWPDARASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFQFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 907 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYRNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDTPTLLRGWPDAQASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFQFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 908 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYRNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDTPTLLNGWPDARASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFQFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 909 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYDNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDTPTLLRGWPDARASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFQFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 910 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYRNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDTPTLLRGWPDARASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFQFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 911 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYRNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVALYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDTPTLLNGWPDARASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFQFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 912 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYDNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDRPTLLNGWPDAQASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFQFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 913 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYDNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDTPTLLNGWPDAQASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFLFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 914 - protein, 1301 aa, synthetic construct
MKQYKDFTGLYPLQKTLRFELKPIGKTKENIERNGILERDNQRAVGYKAIKKVIDEYHKAFIDLMLDNFQLKLLHTGKKDSLEEYYLLYHLSTTDPKRKDDMIKVQEALRKQISERFTKSDQYKRLFGMELIRENLTEFVKAPQYEAIIRSQNGNENLTDGEVRQIQEAVNKDIAQFYDFTTYFVGFYDNRKNMYVADDKATSIAHRMITENLPKFIDNMDVFEKIAASEVASHFEALYKAMEPYLNINSINEMFQLDYFSMVLTQKQIDVYNATIGGMVLDDGTKIQGLNEYVNLYNQQQKDKSNRLPKLKPLFKQILSERNAISWLPDEFESDNDMLESIEKCYQDLKNQVFEGDGSLRNLLKNIGEYDLEHIYLSDDLQLTDIAQKHFGNWSLIKKALEEDVKAKNPQKRNETAEKYEERIEKLLKANESFSLAQINRLMEIYLGDEYKPIETYFAVLGAEDNENGQKPNLFIRIENAHTEANNLLTSAYPVDRKLSQDKANVEKIKNLLDAIKDLQHFVKPLLGKGTESEKDNRFYGEFVPLWETLDQITPLYNMVRNRMTQKPYSEEKIKLNFDRPTLLNGWPDAQASSGAILKDDKGLYYLAILDSMYRTCLNELESCPTERGEMAIMKYLQGGDMGKNVQNLMRIDGITRKVNGRKEKEGALVGQNIRLENAKNTYLPIEINEIRLKQSYLKSSQSFNKKDLARFIEYYIPLVKEYYSDYQFSFRNPSEYESFVEFTDHINQQAYQVQFDPISKEQLFQMVDEGKIYLFQIYNKDFSTYSTGTPNLHTLYWKMLFDERNLADVVYKLNGEAEVFFRKHSIEAGKPTHPANKLIENKNKLNEKKTSVFEYDLVKDRRYTVDKFLFHVPITMNFKAAGLNNINPLVNAYLKESNVTHIIGIDRGERHLLYLSLIDLQGNIVEQYSLNEIVNEYKGNTYRTNYHDLLEAKEKQRDEARRSWQTIENIKELKEGYMSQVVHKIAELMVKYNAIVVLEDLNMGFKRGRQKVEKQVYQKFEKMLIDKLNYLVDKRLDAKETGGVLNAYQLTNTEKVFTKQYGRNKNTLGKQCGFLFYIPAWNTSKMDPTTGFVNLLDTRYENMAKAKAFFGRFRRIRYNATKDWFEFAFDYDEFTAKASGTRTQWTLCTYGTRIETKRDPKQNNNFVSEEFDLTSKFKNLFAQYAIDLKGNLMEQICTQNDAAFFKELLHLLHLTLQMRNSITGTEIDYLISPVLNAKGEFYDSRKCGKNLPLNADANGAYNIARKGLWIIEQIKQTEDLSKLKLAISNKDWMRYTQGLV

SEQ ID NO: 915 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYRNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLKGWPDAQASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 916 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYDNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLRGWPDAQASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 917 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYDNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLKGWPDARASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 918 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYRNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLRGWPDAQASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 919 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYRNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLKGWPDARASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 920 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYDNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLRGWPDARASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 921 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYRNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLRGWPDARASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 922 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYRNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVALYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLKGWPDARASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 923 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYDNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDRPTLLKGWPDAQASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFQFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 924 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYDNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDTPTLLKGWPDAQASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFLFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 925 - protein, 1293 aa, synthetic construct
MSTYSDFTGLYTLSKTLRFELKPIGKTKDNIERNGILDRDSQRAIGYKAIKKVIDEYHKAFIELMLDSFELKLKDEGRMDSLMEFYYLYHLPTIDSKRKDDLKKVQEALRKQISECFTKSEQYKRLFGKELIREDLADFIKTPKYEGVIRSQHDNEDLTEEEIRKIQEEVEKTIDQFYDFTTYFVGFYDNRKNMYVADDKATSIAHRMITKNLPKFIDNMDVFAKISSSEVATHFETLYKEMEAYLNVNSIEEMFQLDYFSMVLTQKQIDVYNSIIGGMVLENGTKIQGLNEYVNLYNQQQKDKGNRLPKLKPLFKQILSERNAISWLPEEFESDNDMLDGIERCYQDLKKQVFNGENSMQVLLKSIGDYDLEHIYLPNDLQLTDIAQKYYGSWSVIKKAMEEDVKANNPQKRNDTGEKYEERITKLLKSKESISIEEINRLMKWLLGDDYKPMENYFSMMGAEDDENGQKPDLFIRIENAYTEAKALLTSVYPEDRKLSQDKKNVERIKNLLDAIKDLQRFVKPLLGGGTESEKDPRFYGEFVPMWEALDQITPLYNMVRNRMTQKPYSEEKIKLNFDRPTLLKGWPDAQASSGAILKDNKGLYYLAILDSMHRTCLNELKSCPTEKSEMAIMKYLQGGDMEKNVQNLMRINGVTRKVNGRKEKEGAMVGQNIRLENAKNTYLPTEINDIRLKQSYLTSSQSFNKQDLALYIEYYMPLVREYYSDYQFSFRNPSEYKSFAEFTDHINQQAYQVQFGSISDKQLFQMVEEGKIYLFQIYNKDFSPYSKGTPNMHTLYWKMLFDERNLADVVYKLNGEAEVFFRKHSIEVGRPTHPANKPIENKNKLNEKKISVFAYDLLKDRRYTVDKFLFHVPITMNFKAAGLNNINPLVNAYLKESKATHIIGIDRGERHLLYLSLIDLQGNIVEQYSLNEIVNEYNGNTYRTNYHDLLDAKEKQRDEARKSWQTIENIKELKEGYMSHVIHKIAELMVKYNAVVVLEDLKPGFMRGRQKVEKQVYQKFEKMLIDKLNYLVDKKLEATEMGGVLNAYQLTNKFESFQKPGKQSGFLFYIPAWNTSKMDPTTGFVNLLDTRYENMAKAKAFFGKFKSIRYNATKDWFEFAFDYNNFHNRAEGTRTQWALCTYGTRIETKRDPKQNNSFVSEEFDLTSKFKKLLAHYAIDLNGNLLEQICSQNDTQFYKDLLHLLHLTLQMRNSITGTDVDYLVSPVMNVYGEFYDSRTCGNNLPKNADANGAYNIARKGLWIIEQIKQTEDLSKLKLAISNKEWMRYAQGLR

SEQ ID NO: 926 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHRNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQSSTLAQGWDLNKEHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFHFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 927 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHKNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQSSTLARGWDLNKEHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFHFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 928 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHKNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQSSTLAQGWDLNREHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFHFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 929 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHRNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQSSTLARGWDLNKEHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFHFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 930 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHRNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQSSTLAQGWDLNREHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFHFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 931 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHKNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQSSTLARGWDLNREHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFHFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 932 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHRNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQSSTLARGWDLNREHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFHFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 933 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHRNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHIALYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQSSTLAQGWDLNREHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFHFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 934 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHKNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQRSTLAQGWDLNKEHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFHFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 935 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHKNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQSSTLAQGWDLNKEHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFLFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 936 - protein, 1297 aa, synthetic construct
MNAQKSFFGDFTNLYSLQKTLRFELEPQGKTLEHIENKGLISQDEQRAESYKKMKKTIDGFHKHFIEIAMSQVKLTKLKEFVDLYNASPERKKEDGFKKSFEKVQTELRKEIAMGFRAGEAKEIFSKIDKKELVTDLLEKWMQTQEEDLYFDESFKTFTTYFGGFHKNRKNMYTDKEQSTSIAYRLVHENLPKFLDNIKVFERIKSIPVLYEKCTTLYTEIKEHLDIKDINEAFNLYCYNKVLTQKQIDAYNLVIGGMTAQEGKKKIQGLNEHINLYNQRQDKKDRIPKLKQLYKQILSDRESVSFLPEAFEDDESKTASQKVLNSIEEYYQANLVSFHPRDKDEAENVLEKIKELLTSLKDYDSNKIYLRNDKAITDISKALFGDWGIIKVALEFAFLQTLKIGEKGLSKKQEKEKENYIKQSHFSVAEIEKALFAYKNEAEVLNDLHENTTPLADYFHTNFLAKKKEESDKEFDLIANIQAKYSCIKGILNRDYPKEKRLHQDKKTIGDIKAFLDSLMELLHFVKQLSLPSDTTLEKDEIFYSQFQPWYDQLQLLIPLYNKVRNYASQKPYSIEKFKLNFQRSTLAQGWDLNKEHNKNYSFIFQENDSFLLGIINIYDDKDILSKDTRPEIFVDDSPLKKMVYKNLGDIKRQLPRIAFSDKAKKCVEKIGWNQEIEAIKKEFDEFQDAKKNDKDLWKDEFDRNQLSELIDYYKGVLKNHSERYEDTYKLEYKSTESYKNLGEFFDHITSQTYKVTFVGIDKNYINRLVDQGKLYLFQIYNKDFSEYSKGKPNLHTLYWKALFDPENLKDVMYKLNGGAELFYRKKSIKDLAIHKANEPIKNKNPNNPKKESVFKYEIVKDYRYTVDKFLFHVPITLNFKATEAGYINNTILGFLKDNPDVNIIGIDRGERHLIYLTLIDQRGNILEQRSLNTIINKKFNVKTDYHGLLDNREKERDKARKNWGTIETIKELKEGYIGIIVHEISRMMVEHNAIVVMEDLNFGFKRGRFKVEKQIYQKLEKKLIDKLNYLIFKDKANNETGGLYKALQLTSKFESFIKLGKQSGFLFYVPAWNTSKIDPTTGFVNLFNTRYENADKAKTFFDNFENICYNVEKGYFEFKVKKYSLFNSKADDTRQEWIICTQGDRIRTFRNPEKSNQWDNKEIVLLDEFKNLFKEYGIRYEEDLKHQILSQTEKTFFEKLLNLFKITVQMRNSITNSETDYLISPVMNAKGEFYDSRKAGDNLPKDADANGAYHIAKKGLWLLKQIDAHEGEDWKKLKLAITNKEWLQFAQARGRL

SEQ ID NO: 937 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQRNRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLADGWDQNKEDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 938 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQENRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLARGWDQNKEDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 939 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQENRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLADGWDQNREDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 940 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQRNRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLARGWDQNKEDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 941 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQRNRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLADGWDQNREDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 942 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQENRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLARGWDQNREDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 943 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQRNRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLARGWDQNREDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 944 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQRNRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTALYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLADGWDQNREDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 945 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQENRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFERPTLADGWDQNKEDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 946 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQENRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLADGWDQNKEDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFLFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 947 - protein, 1255 aa, synthetic construct
MAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQENRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFERPTLADGWDQNKEDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFLFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 948 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQRNRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLADGWDQNNEAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 949 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQENRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLARGWDQNNEAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 950 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQENRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLADGWDQNREAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 951 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQRNRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLARGWDQNNEAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 952 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQRNRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLADGWDQNREAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 953 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQENRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLARGWDQNREAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 954 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQRNRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLARGWDQNREAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 955 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQRNRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFAALYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLADGWDQNREAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 956 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQENRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFERPTLADGWDQNNEAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 957 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQENRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLADGWDQNNEAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFLFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 958 - protein, 1253 aa, synthetic construct
MAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQENRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFERPTLADGWDQNNEAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFLFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 959 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHRNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLSGWPQDYETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 960 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHTNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLRGWPQDYETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 961 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHTNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLSGWPQDRETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 962 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHRNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLRGWPQDYETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 963 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHRNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLSGWPQDRETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 964 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHTNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLRGWPQDRETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 965 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHRNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLRGWPQDRETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 966 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHRNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYIASHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLSGWPQDRETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 967 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHTNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDRSSFLSGWPQDYETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 968 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHTNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLSGWPQDYETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFLFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 969 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHTNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDRSSFLSGWPQDYETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFLFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 970 - protein, 1369 aa, synthetic construct
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQRNRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLADGWDLNKEQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 971 - protein, 1369 aa, synthetic construct
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQENRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLARGWDLNKEQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 972 - protein, 1369 aa, synthetic construct
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQENRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLADGWDLNREQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 973 - protein, 1369 aa, synthetic construct
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQRNRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLARGWDLNKEQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 974 - protein, 1369 aa, synthetic construct
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQRNRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLADGWDLNREQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 975 - protein, 1369 aa, synthetic construct
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQENRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLARGWDLNREQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 976 - protein, 1369 aa, synthetic construct
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQRNRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLARGWDLNREQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 977 - protein, 1369 aa, synthetic construct
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQRNRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLALYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLADGWDLNREQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 978 - protein, 1369 aa, synthetic construct
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQENRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDRPTLADGWDLNKEQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 979 - protein, 1335 aa, synthetic construct
MKMSEQFCGQGNGYSRSITVRNRLIPVGKTEENLKNANLLNSDFERAQAYTEVKNLIDEFHRAFIEDVLSKTKLDWDALYNQFDLFQAEKDNSKKAKQKKELEVLQGKMRNEIVEKFKGDERYDKLFKKELLTDLLPAIIKDDDSGTITDKKTALDTFKGFATYFTGFHRNRENLYSGEAKATAISNRIVNENFPKFYANVNVFEYMQKNFPNIVSDTENSLKDFLKGKKLSEVFSKDNFNAVLSQHGIDFYNTIIGGISGEAGKEKIQGLNEKINLARQQLPAEEKSKLRKKMTMLYKQILSDKKTASFIPVGFEKSEEVYNAVRQYKEHNFDKARHTIDELVSNPDYDLNQIFVPAKELSAFSLSVFGSWSIAGSGLFLLEKDKAKKELSEKQIKNIKKQIDKNDYSLIELQTAYNRWAKENGEQIDKTITISVYAYRTDENTKEKNSVNILEKVSEAYAKIDFERQENLQAEKEAATPIKDFLDEVQNLYHYFKLFDYRGEEEKDSNFYYKLDEILSDLAEIIPLYNKVRNFVTKKPGEVKKVKLNFDNVSLAKGWDVNKESDYTCIILRKSGKYFLGIFNPQDKPNFNEENNANDFNKKNDCYEKLVYKFFKDVTTMIPKCTTQLKDVKKHFESFSEDFILENDSFLKPLTISKTVFDLNNTLYDGKKKFQIDYLRNTNDVDGYNSAVKEWIAFCMNFMKSYKSTSVYDYSVLKDCSQFKQVDQFYNEINLLLYKIWFVNVEEAKIRNLVDSGKLYLFQIYNKDFAEKSSGKKNLHTLYWENLFSEENLRDVCLKLNGEAELFFRPKNENVKEIRHEKGSVLVNRTTADGKSIPEEIYQEIYQFKNKKRASVSDEAQKWLDGGTVVCKEATHTLTKNRHFTQNTYLFHCPITMNFKAPEITGKKFNQKVLKYLHKNPDVKIIGLDRGERHLIYLSLINQNGEIELQKTLNLVEQVRNDKTVSVNYQEKLVQKEGDRDKARKNWQTIGNIKELKEGYLSNVVHEIAKLMVEHNAIIVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTDELKKIFEQCSIDFESGNNLIDSIMEIGAELKQNEKPTSDVANFWDAMLRNFKLILQMRNSNAASGEDYIISPVKNADGIFFDSRKEKELGDKAKLPIDADANGAYHIALKGLLLLKRFDKTEESNLKKADMKISNADWFEFAQNRNN

SEQ ID NO: 980 - protein, 1335 aa, synthetic construct
MKMSEQFCGQGNGYSRSITVRNRLIPVGKTEENLKNANLLNSDFERAQAYTEVKNLIDEFHRAFIEDVLSKTKLDWDALYNQFDLFQAEKDNSKKAKQKKELEVLQGKMRNEIVEKFKGDERYDKLFKKELLTDLLPAIIKDDDSGTITDKKTALDTFKGFATYFTGFHQNRENLYSGEAKATAISNRIVNENFPKFYANVNVFEYMQKNFPNIVSDTENSLKDFLKGKKLSEVFSKDNFNAVLSQHGIDFYNTIIGGISGEAGKEKIQGLNEKINLARQQLPAEEKSKLRKKMTMLYKQILSDKKTASFIPVGFEKSEEVYNAVRQYKEHNFDKARHTIDELVSNPDYDLNQIFVPAKELSAFSLSVFGSWSIAGSGLFLLEKDKAKKELSEKQIKNIKKQIDKNDYSLIELQTAYNRWAKENGEQIDKTITISVYAYRTDENTKEKNSVNILEKVSEAYAKIDFERQENLQAEKEAATPIKDFLDEVQNLYHYFKLFDYRGEEEKDSNFYYKLDEILSDLAEIIPLYNKVRNFVTKKPGEVKKVKLNFDNVSLARGWDVNKESDYTCIILRKSGKYFLGIFNPQDKPNFNEENNANDFNKKNDCYEKLVYKFFKDVTTMIPKCTTQLKDVKKHFESFSEDFILENDSFLKPLTISKTVFDLNNTLYDGKKKFQIDYLRNTNDVDGYNSAVKEWIAFCMNFMKSYKSTSVYDYSVLKDCSQFKQVDQFYNEINLLLYKIWFVNVEEAKIRNLVDSGKLYLFQIYNKDFAEKSSGKKNLHTLYWENLFSEENLRDVCLKLNGEAELFFRPKNENVKEIRHEKGSVLVNRTTADGKSIPEEIYQEIYQFKNKKRASVSDEAQKWLDGGTVVCKEATHTLTKNRHFTQNTYLFHCPITMNFKAPEITGKKFNQKVLKYLHKNPDVKIIGLDRGERHLIYLSLINQNGEIELQKTLNLVEQVRNDKTVSVNYQEKLVQKEGDRDKARKNWQTIGNIKELKEGYLSNVVHEIAKLMVEHNAIIVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTDELKKIFEQCSIDFESGNNLIDSIMEIGAELKQNEKPTSDVANFWDAMLRNFKLILQMRNSNAASGEDYIISPVKNADGIFFDSRKEKELGDKAKLPIDADANGAYHIALKGLLLLKRFDKTEESNLKKADMKISNADWFEFAQNRNN

SEQ ID NO: 981 - protein, 1335 aa, synthetic construct
MKMSEQFCGQGNGYSRSITVRNRLIPVGKTEENLKNANLLNSDFERAQAYTEVKNLIDEFHRAFIEDVLSKTKLDWDALYNQFDLFQAEKDNSKKAKQKKELEVLQGKMRNEIVEKFKGDERYDKLFKKELLTDLLPAIIKDDDSGTITDKKTALDTFKGFATYFTGFHQNRENLYSGEAKATAISNRIVNENFPKFYANVNVFEYMQKNFPNIVSDTENSLKDFLKGKKLSEVFSKDNFNAVLSQHGIDFYNTIIGGISGEAGKEKIQGLNEKINLARQQLPAEEKSKLRKKMTMLYKQILSDKKTASFIPVGFEKSEEVYNAVRQYKEHNFDKARHTIDELVSNPDYDLNQIFVPAKELSAFSLSVFGSWSIAGSGLFLLEKDKAKKELSEKQIKNIKKQIDKNDYSLIELQTAYNRWAKENGEQIDKTITISVYAYRTDENTKEKNSVNILEKVSEAYAKIDFERQENLQAEKEAATPIKDFLDEVQNLYHYFKLFDYRGEEEKDSNFYYKLDEILSDLAEIIPLYNKVRNFVTKKPGEVKKVKLNFDNVSLAKGWDVNRESDYTCIILRKSGKYFLGIFNPQDKPNFNEENNANDFNKKNDCYEKLVYKFFKDVTTMIPKCTTQLKDVKKHFESFSEDFILENDSFLKPLTISKTVFDLNNTLYDGKKKFQIDYLRNTNDVDGYNSAVKEWIAFCMNFMKSYKSTSVYDYSVLKDCSQFKQVDQFYNEINLLLYKIWFVNVEEAKIRNLVDSGKLYLFQIYNKDFAEKSSGKKNLHTLYWENLFSEENLRDVCLKLNGEAELFFRPKNENVKEIRHEKGSVLVNRTTADGKSIPEEIYQEIYQFKNKKRASVSDEAQKWLDGGTVVCKEATHTLTKNRHFTQNTYLFHCPITMNFKAPEITGKKFNQKVLKYLHKNPDVKIIGLDRGERHLIYLSLINQNGEIELQKTLNLVEQVRNDKTVSVNYQEKLVQKEGDRDKARKNWQTIGNIKELKEGYLSNVVHEIAKLMVEHNAIIVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTDELKKIFEQCSIDFESGNNLIDSIMEIGAELKQNEKPTSDVANFWDAMLRNFKLILQMRNSNAASGEDYIISPVKNADGIFFDSRKEKELGDKAKLPIDADANGAYHIALKGLLLLKRFDKTEESNLKKADMKISNADWFEFAQNRNN

SEQ ID NO: 982 - protein, 1335 aa, synthetic construct
MKMSEQFCGQGNGYSRSITVRNRLIPVGKTEENLKNANLLNSDFERAQAYTEVKNLIDEFHRAFIEDVLSKTKLDWDALYNQFDLFQAEKDNSKKAKQKKELEVLQGKMRNEIVEKFKGDERYDKLFKKELLTDLLPAIIKDDDSGTITDKKTALDTFKGFATYFTGFHRNRENLYSGEAKATAISNRIVNENFPKFYANVNVFEYMQKNFPNIVSDTENSLKDFLKGKKLSEVFSKDNFNAVLSQHGIDFYNTIIGGISGEAGKEKIQGLNEKINLARQQLPAEEKSKLRKKMTMLYKQILSDKKTASFIPVGFEKSEEVYNAVRQYKEHNFDKARHTIDELVSNPDYDLNQIFVPAKELSAFSLSVFGSWSIAGSGLFLLEKDKAKKELSEKQIKNIKKQIDKNDYSLIELQTAYNRWAKENGEQIDKTITISVYAYRTDENTKEKNSVNILEKVSEAYAKIDFERQENLQAEKEAATPIKDFLDEVQNLYHYFKLFDYRGEEEKDSNFYYKLDEILSDLAEIIPLYNKVRNFVTKKPGEVKKVKLNFDNVSLARGWDVNKESDYTCIILRKSGKYFLGIFNPQDKPNFNEENNANDFNKKNDCYEKLVYKFFKDVTTMIPKCTTQLKDVKKHFESFSEDFILENDSFLKPLTISKTVFDLNNTLYDGKKKFQIDYLRNTNDVDGYNSAVKEWIAFCMNFMKSYKSTSVYDYSVLKDCSQFKQVDQFYNEINLLLYKIWFVNVEEAKIRNLVDSGKLYLFQIYNKDFAEKSSGKKNLHTLYWENLFSEENLRDVCLKLNGEAELFFRPKNENVKEIRHEKGSVLVNRTTADGKSIPEEIYQEIYQFKNKKRASVSDEAQKWLDGGTVVCKEATHTLTKNRHFTQNTYLFHCPITMNFKAPEITGKKFNQKVLKYLHKNPDVKIIGLDRGERHLIYLSLINQNGEIELQKTLNLVEQVRNDKTVSVNYQEKLVQKEGDRDKARKNWQTIGNIKELKEGYLSNVVHEIAKLMVEHNAIIVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTDELKKIFEQCSIDFESGNNLIDSIMEIGAELKQNEKPTSDVANFWDAMLRNFKLILQMRNSNAASGEDYIISPVKNADGIFFDSRKEKELGDKAKLPIDADANGAYHIALKGLLLLKRFDKTEESNLKKADMKISNADWFEFAQNRNN

SEQ ID NO: 983 - protein, 1335 aa, synthetic construct
MKMSEQFCGQGNGYSRSITVRNRLIPVGKTEENLKNANLLNSDFERAQAYTEVKNLIDEFHRAFIEDVLSKTKLDWDALYNQFDLFQAEKDNSKKAKQKKELEVLQGKMRNEIVEKFKGDERYDKLFKKELLTDLLPAIIKDDDSGTITDKKTALDTFKGFATYFTGFHRNRENLYSGEAKATAISNRIVNENFPKFYANVNVFEYMQKNFPNIVSDTENSLKDFLKGKKLSEVFSKDNFNAVLSQHGIDFYNTIIGGISGEAGKEKIQGLNEKINLARQQLPAEEKSKLRKKMTMLYKQILSDKKTASFIPVGFEKSEEVYNAVRQYKEHNFDKARHTIDELVSNPDYDLNQIFVPAKELSAFSLSVFGSWSIAGSGLFLLEKDKAKKELSEKQIKNIKKQIDKNDYSLIELQTAYNRWAKENGEQIDKTITISVYAYRTDENTKEKNSVNILEKVSEAYAKIDFERQENLQAEKEAATPIKDFLDEVQNLYHYFKLFDYRGEEEKDSNFYYKLDEILSDLAEIIPLYNKVRNFVTKKPGEVKKVKLNFDNVSLAKGWDVNRESDYTCIILRKSGKYFLGIFNPQDKPNFNEENNANDFNKKNDCYEKLVYKFFKDVTTMIPKCTTQLKDVKKHFESFSEDFILENDSFLKPLTISKTVFDLNNTLYDGKKKFQIDYLRNTNDVDGYNSAVKEWIAFCMNFMKSYKSTSVYDYSVLKDCSQFKQVDQFYNEINLLLYKIWFVNVEEAKIRNLVDSGKLYLFQIYNKDFAEKSSGKKNLHTLYWENLFSEENLRDVCLKLNGEAELFFRPKNENVKEIRHEKGSVLVNRTTADGKSIPEEIYQEIYQFKNKKRASVSDEAQKWLDGGTVVCKEATHTLTKNRHFTQNTYLFHCPITMNFKAPEITGKKFNQKVLKYLHKNPDVKIIGLDRGERHLIYLSLINQNGEIELQKTLNLVEQVRNDKTVSVNYQEKLVQKEGDRDKARKNWQTIGNIKELKEGYLSNVVHEIAKLMVEHNAIIVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTDELKKIFEQCSIDFESGNNLIDSIMEIGAELKQNEKPTSDVANFWDAMLRNFKLILQMRNSNAASGEDYIISPVKNADGIFFDSRKEKELGDKAKLPIDADANGAYHIALKGLLLLKRFDKTEESNLKKADMKISNADWFEFAQNRNN

SEQ ID NO: 984 - protein, 1335 aa, synthetic construct
MKMSEQFCGQGNGYSRSITVRNRLIPVGKTEENLKNANLLNSDFERAQAYTEVKNLIDEFHRAFIEDVLSKTKLDWDALYNQFDLFQAEKDNSKKAKQKKELEVLQGKMRNEIVEKFKGDERYDKLFKKELLTDLLPAIIKDDDSGTITDKKTALDTFKGFATYFTGFHQNRENLYSGEAKATAISNRIVNENFPKFYANVNVFEYMQKNFPNIVSDTENSLKDFLKGKKLSEVFSKDNFNAVLSQHGIDFYNTIIGGISGEAGKEKIQGLNEKINLARQQLPAEEKSKLRKKMTMLYKQILSDKKTASFIPVGFEKSEEVYNAVRQYKEHNFDKARHTIDELVSNPDYDLNQIFVPAKELSAFSLSVFGSWSIAGSGLFLLEKDKAKKELSEKQIKNIKKQIDKNDYSLIELQTAYNRWAKENGEQIDKTITISVYAYRTDENTKEKNSVNILEKVSEAYAKIDFERQENLQAEKEAATPIKDFLDEVQNLYHYFKLFDYRGEEEKDSNFYYKLDEILSDLAEIIPLYNKVRNFVTKKPGEVKKVKLNFDNVSLARGWDVNRESDYTCIILRKSGKYFLGIFNPQDKPNFNEENNANDFNKKNDCYEKLVYKFFKDVTTMIPKCTTQLKDVKKHFESFSEDFILENDSFLKPLTISKTVFDLNNTLYDGKKKFQIDYLRNTNDVDGYNSAVKEWIAFCMNFMKSYKSTSVYDYSVLKDCSQFKQVDQFYNEINLLLYKIWFVNVEEAKIRNLVDSGKLYLFQIYNKDFAEKSSGKKNLHTLYWENLFSEENLRDVCLKLNGEAELFFRPKNENVKEIRHEKGSVLVNRTTADGKSIPEEIYQEIYQFKNKKRASVSDEAQKWLDGGTVVCKEATHTLTKNRHFTQNTYLFHCPITMNFKAPEITGKKFNQKVLKYLHKNPDVKIIGLDRGERHLIYLSLINQNGEIELQKTLNLVEQVRNDKTVSVNYQEKLVQKEGDRDKARKNWQTIGNIKELKEGYLSNVVHEIAKLMVEHNAIIVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTDELKKIFEQCSIDFESGNNLIDSIMEIGAELKQNEKPTSDVANFWDAMLRNFKLILQMRNSNAASGEDYIISPVKNADGIFFDSRKEKELGDKAKLPIDADANGAYHIALKGLLLLKRFDKTEESNLKKADMKISNADWFEFAQNRNN

SEQ ID NO: 985 - protein, 1335 aa, synthetic construct
MKMSEQFCGQGNGYSRSITVRNRLIPVGKTEENLKNANLLNSDFERAQAYTEVKNLIDEFHRAFIEDVLSKTKLDWDALYNQFDLFQAEKDNSKKAKQKKELEVLQGKMRNEIVEKFKGDERYDKLFKKELLTDLLPAIIKDDDSGTITDKKTALDTFKGFATYFTGFHRNRENLYSGEAKATAISNRIVNENFPKFYANVNVFEYMQKNFPNIVSDTENSLKDFLKGKKLSEVFSKDNFNAVLSQHGIDFYNTIIGGISGEAGKEKIQGLNEKINLARQQLPAEEKSKLRKKMTMLYKQILSDKKTASFIPVGFEKSEEVYNAVRQYKEHNFDKARHTIDELVSNPDYDLNQIFVPAKELSAFSLSVFGSWSIAGSGLFLLEKDKAKKELSEKQIKNIKKQIDKNDYSLIELQTAYNRWAKENGEQIDKTITISVYAYRTDENTKEKNSVNILEKVSEAYAKIDFERQENLQAEKEAATPIKDFLDEVQNLYHYFKLFDYRGEEEKDSNFYYKLDEILSDLAEIIPLYNKVRNFVTKKPGEVKKVKLNFDNVSLARGWDVNRESDYTCIILRKSGKYFLGIFNPQDKPNFNEENNANDFNKKNDCYEKLVYKFFKDVTTMIPKCTTQLKDVKKHFESFSEDFILENDSFLKPLTISKTVFDLNNTLYDGKKKFQIDYLRNTNDVDGYNSAVKEWIAFCMNFMKSYKSTSVYDYSVLKDCSQFKQVDQFYNEINLLLYKIWFVNVEEAKIRNLVDSGKLYLFQIYNKDFAEKSSGKKNLHTLYWENLFSEENLRDVCLKLNGEAELFFRPKNENVKEIRHEKGSVLVNRTTADGKSIPEEIYQEIYQFKNKKRASVSDEAQKWLDGGTVVCKEATHTLTKNRHFTQNTYLFHCPITMNFKAPEITGKKFNQKVLKYLHKNPDVKIIGLDRGERHLIYLSLINQNGEIELQKTLNLVEQVRNDKTVSVNYQEKLVQKEGDRDKARKNWQTIGNIKELKEGYLSNVVHEIAKLMVEHNAIIVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTDELKKIFEQCSIDFESGNNLIDSIMEIGAELKQNEKPTSDVANFWDAMLRNFKLILQMRNSNAASGEDYIISPVKNADGIFFDSRKEKELGDKAKLPIDADANGAYHIALKGLLLLKRFDKTEESNLKKADMKISNADWFEFAQNRNN

SEQ ID NO: 986 - protein, 1335 aa, synthetic construct
MKMSEQFCGQGNGYSRSITVRNRLIPVGKTEENLKNANLLNSDFERAQAYTEVKNLIDEFHRAFIEDVLSKTKLDWDALYNQFDLFQAEKDNSKKAKQKKELEVLQGKMRNEIVEKFKGDERYDKLFKKELLTDLLPAIIKDDDSGTITDKKTALDTFKGFATYFTGFHRNRENLYSGEAKATAISNRIVNENFPKFYANVNVFEYMQKNFPNIVSDTENSLKDFLKGKKLSEVFSKDNFNAVLSQHGIDFYNTIIGGISGEAGKEKIQGLNEKIALARQQLPAEEKSKLRKKMTMLYKQILSDKKTASFIPVGFEKSEEVYNAVRQYKEHNFDKARHTIDELVSNPDYDLNQIFVPAKELSAFSLSVFGSWSIAGSGLFLLEKDKAKKELSEKQIKNIKKQIDKNDYSLIELQTAYNRWAKENGEQIDKTITISVYAYRTDENTKEKNSVNILEKVSEAYAKIDFERQENLQAEKEAATPIKDFLDEVQNLYHYFKLFDYRGEEEKDSNFYYKLDEILSDLAEIIPLYNKVRNFVTKKPGEVKKVKLNFDNVSLAKGWDVNRESDYTCIILRKSGKYFLGIFNPQDKPNFNEENNANDFNKKNDCYEKLVYKFFKDVTTMIPKCTTQLKDVKKHFESFSEDFILENDSFLKPLTISKTVFDLNNTLYDGKKKFQIDYLRNTNDVDGYNSAVKEWIAFCMNFMKSYKSTSVYDYSVLKDCSQFKQVDQFYNEINLLLYKIWFVNVEEAKIRNLVDSGKLYLFQIYNKDFAEKSSGKKNLHTLYWENLFSEENLRDVCLKLNGEAELFFRPKNENVKEIRHEKGSVLVNRTTADGKSIPEEIYQEIYQFKNKKRASVSDEAQKWLDGGTVVCKEATHTLTKNRHFTQNTYLFHCPITMNFKAPEITGKKFNQKVLKYLHKNPDVKIIGLDRGERHLIYLSLINQNGEIELQKTLNLVEQVRNDKTVSVNYQEKLVQKEGDRDKARKNWQTIGNIKELKEGYLSNVVHEIAKLMVEHNAIIVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTDELKKIFEQCSIDFESGNNLIDSIMEIGAELKQNEKPTSDVANFWDAMLRNFKLILQMRNSNAASGEDYIISPVKNADGIFFDSRKEKELGDKAKLPIDADANGAYHIALKGLLLLKRFDKTEESNLKKADMKISNADWFEFAQNRNN

SEQ ID NO: 987 - protein, 1335 aa, synthetic construct
MKMSEQFCGQGNGYSRSITVRNRLIPVGKTEENLKNANLLNSDFERAQAYTEVKNLIDEFHRAFIEDVLSKTKLDWDALYNQFDLFQAEKDNSKKAKQKKELEVLQGKMRNEIVEKFKGDERYDKLFKKELLTDLLPAIIKDDDSGTITDKKTALDTFKGFATYFTGFHQNRENLYSGEAKATAISNRIVNENFPKFYANVNVFEYMQKNFPNIVSDTENSLKDFLKGKKLSEVFSKDNFNAVLSQHGIDFYNTIIGGISGEAGKEKIQGLNEKINLARQQLPAEEKSKLRKKMTMLYKQILSDKKTASFIPVGFEKSEEVYNAVRQYKEHNFDKARHTIDELVSNPDYDLNQIFVPAKELSAFSLSVFGSWSIAGSGLFLLEKDKAKKELSEKQIKNIKKQIDKNDYSLIELQTAYNRWAKENGEQIDKTITISVYAYRTDENTKEKNSVNILEKVSEAYAKIDFERQENLQAEKEAATPIKDFLDEVQNLYHYFKLFDYRGEEEKDSNFYYKLDEILSDLAEIIPLYNKVRNFVTKKPGEVKKVKLNFDRVSLAKGWDVNKESDYTCIILRKSGKYFLGIFNPQDKPNFNEENNANDFNKKNDCYEKLVYKFFKDVTTMIPKCTTQLKDVKKHFESFSEDFILENDSFLKPLTISKTVFDLNNTLYDGKKKFQIDYLRNTNDVDGYNSAVKEWIAFCMNFMKSYKSTSVYDYSVLKDCSQFKQVDQFYNEINLLLYKIWFVNVEEAKIRNLVDSGKLYLFQIYNKDFAEKSSGKKNLHTLYWENLFSEENLRDVCLKLNGEAELFFRPKNENVKEIRHEKGSVLVNRTTADGKSIPEEIYQEIYQFKNKKRASVSDEAQKWLDGGTVVCKEATHTLTKNRHFTQNTYLFHCPITMNFKAPEITGKKFNQKVLKYLHKNPDVKIIGLDRGERHLIYLSLINQNGEIELQKTLNLVEQVRNDKTVSVNYQEKLVQKEGDRDKARKNWQTIGNIKELKEGYLSNVVHEIAKLMVEHNAIIVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTDELKKIFEQCSIDFESGNNLIDSIMEIGAELKQNEKPTSDVANFWDAMLRNFKLILQMRNSNAASGEDYIISPVKNADGIFFDSRKEKELGDKAKLPIDADANGAYHIALKGLLLLKRFDKTEESNLKKADMKISNADWFEFAQNRNN

SEQ ID NO: 988 - protein, 1301 aa, synthetic construct
MWTGEWVFSFYYGAEQIDSRGKNRRKFEKRKSVEQRFRACAAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHRNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLNVWGRDFGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKAEMKISNAEWFEFAQNRKV

SEQ ID NO: 989 - protein, 1301 aa, synthetic construct
MWTGEWVFSFYYGAEQIDSRGKNRRKFEKRKSVEQRFRACAAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHQNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLRVWGRDFGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKAEMKISNAEWFEFAQNRKV

SEQ ID NO: 990 - protein, 1301 aa, synthetic construct
MWTGEWVFSFYYGAEQIDSRGKNRRKFEKRKSVEQRFRACAAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHQNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLNVWGRDRGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKAEMKISNAEWFEFAQNRKV

SEQ ID NO: 991 - protein, 1301 aa, synthetic construct
MWTGEWVFSFYYGAEQIDSRGKNRRKFEKRKSVEQRFRACAAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHRNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLRVWGRDFGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKAEMKISNAEWFEFAQNRKV

SEQ ID NO: 992 - protein, 1301 aa, synthetic construct
MWTGEWVFSFYYGAEQIDSRGKNRRKFEKRKSVEQRFRACAAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHRNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLNVWGRDRGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKAEMKISNAEWFEFAQNRKV

SEQ ID NO: 993 - protein, 1301 aa, synthetic construct
MWTGEWVFSFYYGAEQIDSRGKNRRKFEKRKSVEQRFRACAAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHQNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLRVWGRDRGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKAEMKISNAEWFEFAQNRKV

SEQ ID NO: 994 - protein, 1301 aa, synthetic construct
MWTGEWVFSFYYGAEQIDSRGKNRRKFEKRKSVEQRFRACAAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHRNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLRVWGRDRGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKAEMKISNAEWFEFAQNRKV

SEQ ID NO: 995 - protein, 1301 aa, synthetic construct
MWTGEWVFSFYYGAEQIDSRGKNRRKFEKRKSVEQRFRACAAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHRNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKIALAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFECSSFLNVWGRDRGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKAEMKISNAEWFEFAQNRKV

SEQ ID NO: 996 - protein, 1301 aa, synthetic construct
MWTGEWVFSFYYGAEQIDSRGKNRRKFEKRKSVEQRFRACAAYTEVKNLIDEFHCAFIEDILSKTKLDWETLYDQFDLFQAENDSSKKAKQKKELEVLQGKMRNKIVEKFKGDERFEKLFKKELLSDLLPSMIRDDDSGTITDKQTALNTFKGFATYFTGFHQNRKNLYSDEAKATAISNRIVNENFPKFYANVNVFEYVQKNFPNIVSDTENSLKDFLKGKKLSEIFSKDNFNAVLSQHGIDFYNTVIGGFSGEAGSEKVQGLNEKINLAQQQLPAEEKSKLRKKMTMLYKQILSDKKTASFIPVGFEKSEEVYNAVRQYKEQNFDKARHTIDELISNPDYDLNQIFVPAKELSAFSLSVFGSWSIAVSGLFLLEKDKAKKELSEKQIENITKQIAKNDYSLIELQVAYSRWAKENDEQIDKSITISAYTYRTNENTKEKKLVNILEKVSEAYAKIDFERQENLQAEKEAAMPIKNFLDEVQNLYHYFKLFDYRGEEEKDSNFYSKLDEILSDLAEIIPFYNRVRNFVTKKPGEVKKVKLNFERSSFLNVWGRDFGAKDAHIFIYGEKYYLGIINEKLNNEDIEKLKIASDCKHVIYDSQTPDNKNTPRLFIRSKGTSFAPAVEKYNLPIESVMDLYDKRLFKTNNRDKNQKEYKEALVKIIDYFKLGFTRHESYKNYPFCWKNSNQYNDIAEFYSDTIKSCYRLKFENISYENLLSLVDSGKLYLFQIYNKDFAEKSSGKKNLHTLYWENLFSEENLRDVCLKLNEEAELFFRPKNENAKEIRHEKGSVLVNRTTADGKSIPEEIYQEIYQFKNKKRASVSDEAQKWLDGGTVVCKKATHTLTKDRHFTQDTYLFHCPITMNFKAPEITGKKFNQKVLDYLHKNPDVKIIGLDRGERHLIYLSLINQNGEIELQKTLNLVEQVRNDKTISVNYQEKLVQKEGDRDKARKNWQTIGNIKELKEGYLSNVVHEIAKLMVEHNAIVVMEDLNFGFKRGRFAVERQVYQKFENMLIEKLNYLVFKNRAATEPGGVLNAYQLTDKSANVSDVGKQSGFLFYVPAAYTSKIDPKTGFADLLNLRDLTNVHKKRDFFSKFDEIRYDAETESFAFTFDYKNFDGKGKSEMSATKWTVYSREKRIVYSPKSKSHSDVYPTNELKKIFNQSSIDFESGNNLIDSIMEIGADLKQNEKPTSDVANFWDALLRNFKLILQMRNSNAASGEDYIISPAKNADGTFFDSRKEKELGDKAKLPTDADANGAYHIALKGLLLLKRFDKTEESNLKKAEMKISNAEWFEFAQNRKV

SEQ ID NO: 997 - protein, 1264 aa, synthetic construct
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNKITEAFRKNSLFTNLFKKNLIKEYLPAFVSEEEKSVVNKFSKFTTYFDAFNRNRKNLYSGDAKSGTIAYRLIHENLPVFLDNIASFNAISGTGVNECFLGIETEFTDTLKGKRLTEFFQIDFFNNTLTQKKIDNYNYIVGAVNKAVNLYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLSGWSDNQTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 998 - protein, 1264 aa, synthetic construct
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNKITEAFRKNSLFTNLFKKNLIKEYLPAFVSEEEKSVVNKFSKFTTYFDAFNDNRKNLYSGDAKSGTIAYRLIHENLPVFLDNIASFNAISGTGVNECFLGIETEFTDTLKGKRLTEFFQIDFFNNTLTQKKIDNYNYIVGAVNKAVNLYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLRGWSDNQTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 999 - protein, 1264 aa, synthetic construct
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNKITEAFRKNSLFTNLFKKNLIKEYLPAFVSEEEKSVVNKFSKFTTYFDAFNDNRKNLYSGDAKSGTIAYRLIHENLPVFLDNIASFNAISGTGVNECFLGIETEFTDTLKGKRLTEFFQIDFFNNTLTQKKIDNYNYIVGAVNKAVNLYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLSGWSDNRTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 1000 - protein, 1264 aa, synthetic construct
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNKITEAFRKNSLFTNLFKKNLIKEYLPAFVSEEEKSVVNKFSKFTTYFDAFNRNRKNLYSGDAKSGTIAYRLIHENLPVFLDNIASFNAISGTGVNECFLGIETEFTDTLKGKRLTEFFQIDFFNNTLTQKKIDNYNYIVGAVNKAVNLYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLRGWSDNQTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 1001 - protein, 1264 aa, synthetic construct
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNKITEAFRKNSLFTNLFKKNLIKEYLPAFVSEEEKSVVNKFSKFTTYFDAFNRNRKNLYSGDAKSGTIAYRLIHENLPVFLDNIASFNAISGTGVNECFLGIETEFTDTLKGKRLTEFFQIDFFNNTLTQKKIDNYNYIVGAVNKAVNLYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLSGWSDNRTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 1002 - protein, 1264 aa, synthetic construct
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNKITEAFRKNSLFTNLFKKNLIKEYLPAFVSEEEKSVVNKFSKFTTYFDAFNDNRKNLYSGDAKSGTIAYRLIHENLPVFLDNIASFNAISGTGVNECFLGIETEFTDTLKGKRLTEFFQIDFFNNTLTQKKIDNYNYIVGAVNKAVNLYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLRGWSDNRTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 1003 - protein, 1264 aa, synthetic construct
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNKITEAFRKNSLFTNLFKKNLIKEYLPAFVSEEEKSVVNKFSKFTTYFDAFNRNRKNLYSGDAKSGTIAYRLIHENLPVFLDNIASFNAISGTGVNECFLGIETEFTDTLKGKRLTEFFQIDFFNNTLTQKKIDNYNYIVGAVNKAVNLYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLRGWSDNRTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 1004 - protein, 1264 aa, synthetic construct
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNKITEAFRKNSLFTNLFKKNLIKEYLPAFVSEEEKSVVNKFSKFTTYFDAFNRNRKNLYSGDAKSGTIAYRLIHENLPVFLDNIASFNAISGTGVNECFLGIETEFTDTLKGKRLTEFFQIDFFNNTLTQKKIDNYNYIVGAVNKAVALYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFENNGKLLSGWSDNRTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 1005 - protein, 1264 aa, synthetic construct
MKEIKELTGLYSLTKTIGVELKPVGKTQELIEAKKLIEQDDQRAEDYKIVKDIIDRYHKDFIDKCLNCVKIKKDDLEKYVSLAENSNRDAEDFDNIKTKMRNKITEAFRKNSLFTNLFKKNLIKEYLPAFVSEEEKSVVNKFSKFTTYFDAFNDNRKNLYSGDAKSGTIAYRLIHENLPVFLDNIASFNAISGTGVNECFLGIETEFTDTLKGKRLTEFFQIDFFNNTLTQKKIDNYNYIVGAVNKAVNLYKQQHKTVRVPLLKPLYKMILSDRIAPSWLPECFKSDNDMLTAIKAAYESLRDVLVGDNADSLRNLLLDIDNFDLEHIYIAKDSGLTSISQQIFGYYDTYTLAIKDQLQRENPNLYDERIDKLYKKEGSFSIAYLNRLVDTKEHITINEYYRLLGSYCREKGKRKDDFFKQIDGAYCAISHLFWGKHGEIAQSDSDIELIQKLFDAYKGLQRFIKPLLGHGDEADKDNEFDAKLRKVWDELDIITPLYDKVRNWLSRKIYNPEKIKLCFERNGKLLSGWSDNQTKSDNGTQYGGYIFRKKNEIGEYDFYLGISADAKLFRRDETICYEDGMYERFDYYHLKPNTLLGKSYIGNYGEDSKAVLSAFNAAITKLQLEKKLVPKDNEKVPTYLKRLKQNYANFYQILMNDDNVVDAYKSMKQHILATLATLIRVPAAIELAAQTDLDVDELIDEIMNLPSESFGYFPVATAAIEEANKREKKPLFLFKMSNKDLSYAAKSSEGLRKSRGTENLHTMYLKALLGMTQNVFSIGSGMVFFRHKTKGLAETTARHKANEFIANKNKLNDKKKSIFAYEIVKNKRFTVDKYLFKLSVKLNYSQPNNNKIDVNSEVREIISNGGIKHIIGIDRGERNLLYLSLIDLKGNIVMQKSLNILKDDHNAKGTDYKGLLTEREGERQDARRNWKKIANIKDLKRGYLSQVVHIISKMMVEYNAIVVLEDLNPGFIRGRQKIERNVYEQFERMLIDKLNFYVDKHKEANETGGLLHALQLTSEFENFKKSEHQNGCLFYIPAWNTSKIDPATGFANLFDTRYTNAVEAQEFFSKFDEIRYNEEKDWFEFEFDYDKFTQKAHGTRTKWTLCTYGMRLRSFKNPAKQYNWDSEVVALTDEFKRILEEAGIDIHENLKDAIRNLKGKKQKNLEPLMQFMKLLLQLRNSKAGTDEDYILSPVADENGIFYDSRSCGDELPENADANGAYNIARKGLMMIEQIKNAEDLNNVKFDISNKAWLNFAQQKPYKNG

SEQ ID NO: 1006 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHRNRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNKEQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1007 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHENRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMRGWDLNKEQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1008 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHENRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNREQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1009 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHRNRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMRGWDLNKEQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1010 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHRNRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNREQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1011 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHENRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMRGWDLNREQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1012 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHRNRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMRGWDLNREQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1013 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHRNRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYIALYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNREQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1014 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHENRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFERSTLMNGWDLNKEQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFQFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1015 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHENRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFENSTLMNGWDLNKEQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFLFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1016 - protein, 1252 aa, synthetic construct
MKKLNAFSRIYPLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITKRFSDDDRFKRIDKKELIKEDLLSFVEDVEKRQLIEEFKDFTTYFTGFHENRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLDEQVFNRKKEGEHSLKELLLSLSNYDLTKIYIRNDTQMTDISQKAFGHWDVIPKALLEQLKKEVQKKSKESEEAYEERLNKIIKSQGSIPIALINEGVQKQNSEEQNTLQTYFALLGAVETESVKKENLYIQIENAYAEVKDLLNTPYSGKNLAQDNVAVEKIKTLLDAIKALQHFVKPLLGDGTESEKDEKFYGEFSMLWEELDKITPLYNMVRNYMTRKPYSTEKIKLNFERSTLMNGWDLNKEQDNTTVILRKDGLYYLAIMDKKHNRVFDVKYISKNGECFEKMEYKLLPGANKMLPKVFFSKSRIDEFAPSEQLLENYNKGTHKKGNLFNLSDCHALIDFFKASINKHKDWSKFGFKFSDTNTYEDLSGFYREVEQQGYNISFRNVSVDYINSLVEEGKIYLFQIYNKDFSPYSKGTPNLHTLYWKMLFDEKNLEDVVYKLNGQAEVFFRKSSIICERPTHPANQAINNKNVLNKKKHSTFVYDLVKDKRYTVDKFLFHVPITMNFKSTGGDNINLLVNEYIQQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDCGVLNAYQLTNKFDSFQKLGKQSGFLFYTQAWNTSKIDPVTGFVNLFDTRYETREKSKTFFGKFDAIRYNVEKDWFEFTFDYSNFTSKADGSRTNWTLCTCGERIETFRDEKQNSNWTTRGINLTDKFKEFFAEYKIDIQTDLKEVISRQDSADFFKRLLYLLKLTLQMRNSETGTEVDYMQSPVADANGNFYNSDTCNDSLPKNADANGAYNIARKGLWIVQQIKVADDLKNVKLSISNKEWLKFAQEKPYLNE

SEQ ID NO: 1017 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNRNRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLNGWDLNKERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1018 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNENRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLRGWDLNKERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1019 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNENRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLNGWDLNRERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1020 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNRNRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLRGWDLNKERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1021 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNRNRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLNGWDLNRERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1022 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNENRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLRGWDLNRERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1023 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNRNRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLRGWDLNRERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1024 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNRNRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYIALYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLNGWDLNRERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1025 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNENRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQRSTLLNGWDLNKERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1026 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNENRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLNGWDLNKERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYLFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1027 - protein, 1236 aa, synthetic construct
MANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNENRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQRSTLLNGWDLNKERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYLFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 1028 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWRARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLARGWSESKISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1029 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWEARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLARGWSESKISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1030 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWEARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLADGWSESRISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1031 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWRARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLADGWSESRISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1032 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWEARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLARGWSESRISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1033 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWRARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLARGWSESRISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1034 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWRARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILALTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLADGWSESRISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1035 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWEARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDRPTLADGWSESKISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1036 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWEARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLADGWSESKISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFLFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1037 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWEARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDRPTLADGWSESKISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFLFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1038 - protein, 1034 aa, synthetic construct
MIKEQIRKVRSCKLEELYKQILSDRSIISFRLNEIKNDGELCQLIQNLFRINFNNEIVCKKEIIDKETAEIIEEVNISEHLENSFRHISEADPDQLYIRNDRALTDISQAIFGNWSLIGNSLKFYAEKEELGKNKNGIPKKLTSKEQEMWLKHNYFSFGTIHKALQSYFNQFDANELDKEPSDAQNSANAITVETKELAENKPLFEYFKSFETSKKNKETNAFEKVSLLKSVKSAFQPALEMLKKYENEGGEKLKNEKTDVEKIKIYLDALMDLLHFLKPLYVELSRKEEMKAEVFEKDTGFYDDFDKAYNTLKQIIPLYNQTRNHLTKKPFSVEKYKLNFDNSTLARGWDKNKETANTAVILIKDGKYFLAIMTKEYNKLFQTEPHINTAPAYKKMDYKLLPGASKMLPKVFFSNKNIDYYNPSKEVLHIRNHGTHTKNGRPQKGFTKQDFTKKDCHTMVNFYKNSISRHAEWKEFNFEFSQTNSYNTIDEFYREVEQKGYKITFSDISESYINQCVKEGKLYLFEIYSKDFSKHSKGKPNLQTLYWKEIFSERNLKNVVYKLNGEAELFFRKASIQYPDIVWKEGHHKNDPLKKQKYPIIKDRRYAKDTFLFHCPVTCNFKAQGIPRFNDKVNTFLKNNPDVNILGIDRGERHLAYWTLINQKREIIKQGSFNNPQGKKDYHDLLDIREKERDKARKSWSTIEKIKDLKAGYLSLLVHKIAKMVEEHNAIVVFEDLNFGFKRGRFKVEKQIYQKLEKALIDKLNYLVFKDKNTAEAGGVLNGLQLTAPFESFQKMGKQTGVVFYVPAYHTSKVCPATGFVNLLYPRYETIKKSQEFFKNFCEIKFNSQEDYFEFSFNYEKFTKKAEGSRQNWTLYTYGERLENYRNSLQNNQWDTREVKLTEAFKKLFNQYVIDFNDGTDIKDQIVRQTEGKFFRQLTHLLKLTLQLRNSRINSDEDWMISPVRGNNGTFFDSRKEDSKMPENADANGAYHIGLKGLWVLEQINNQEEGKKLSIAITNKEWYQFIQDKKYQE

SEQ ID NO: 1039 - protein, 1034 aa, synthetic construct
MIKEQIRKVRSCKLEELYKQILSDRSIISFRLNEIKNDGELCQLIQNLFRINFNNEIVCKKEIIDKETAEIIEEVNISEHLENSFRHISEADPDQLYIRNDRALTDISQAIFGNWSLIGNSLKFYAEKEELGKNKNGIPKKLTSKEQEMWLKHNYFSFGTIHKALQSYFNQFDANELDKEPSDAQNSANAITVETKELAENKPLFEYFKSFETSKKNKETNAFEKVSLLKSVKSAFQPALEMLKKYENEGGEKLKNEKTDVEKIKIYLDALMDLLHFLKPLYVELSRKEEMKAEVFEKDTGFYDDFDKAYNTLKQIIPLYNQTRNHLTKKPFSVEKYKLNFDNSTLAAGWDKNRETANTAVILIKDGKYFLAIMTKEYNKLFQTEPHINTAPAYKKMDYKLLPGASKMLPKVFFSNKNIDYYNPSKEVLHIRNHGTHTKNGRPQKGFTKQDFTKKDCHTMVNFYKNSISRHAEWKEFNFEFSQTNSYNTIDEFYREVEQKGYKITFSDISESYINQCVKEGKLYLFEIYSKDFSKHSKGKPNLQTLYWKEIFSERNLKNVVYKLNGEAELFFRKASIQYPDIVWKEGHHKNDPLKKQKYPIIKDRRYAKDTFLFHCPVTCNFKAQGIPRFNDKVNTFLKNNPDVNILGIDRGERHLAYWTLINQKREIIKQGSFNNPQGKKDYHDLLDIREKERDKARKSWSTIEKIKDLKAGYLSLLVHKIAKMVEEHNAIVVFEDLNFGFKRGRFKVEKQIYQKLEKALIDKLNYLVFKDKNTAEAGGVLNGLQLTAPFESFQKMGKQTGVVFYVPAYHTSKVCPATGFVNLLYPRYETIKKSQEFFKNFCEIKFNSQEDYFEFSFNYEKFTKKAEGSRQNWTLYTYGERLENYRNSLQNNQWDTREVKLTEAFKKLFNQYVIDFNDGTDIKDQIVRQTEGKFFRQLTHLLKLTLQLRNSRINSDEDWMISPVRGNNGTFFDSRKEDSKMPENADANGAYHIGLKGLWVLEQINNQEEGKKLSIAITNKEWYQFIQDKKYQE

SEQ ID NO: 1040 - protein, 1034 aa, synthetic construct
MIKEQIRKVRSCKLEELYKQILSDRSIISFRLNEIKNDGELCQLIQNLFRINFNNEIVCKKEIIDKETAEIIEEVNISEHLENSFRHISEADPDQLYIRNDRALTDISQAIFGNWSLIGNSLKFYAEKEELGKNKNGIPKKLTSKEQEMWLKHNYFSFGTIHKALQSYFNQFDANELDKEPSDAQNSANAITVETKELAENKPLFEYFKSFETSKKNKETNAFEKVSLLKSVKSAFQPALEMLKKYENEGGEKLKNEKTDVEKIKIYLDALMDLLHFLKPLYVELSRKEEMKAEVFEKDTGFYDDFDKAYNTLKQIIPLYNQTRNHLTKKPFSVEKYKLNFDNSTLARGWDKNRETANTAVILIKDGKYFLAIMTKEYNKLFQTEPHINTAPAYKKMDYKLLPGASKMLPKVFFSNKNIDYYNPSKEVLHIRNHGTHTKNGRPQKGFTKQDFTKKDCHTMVNFYKNSISRHAEWKEFNFEFSQTNSYNTIDEFYREVEQKGYKITFSDISESYINQCVKEGKLYLFEIYSKDFSKHSKGKPNLQTLYWKEIFSERNLKNVVYKLNGEAELFFRKASIQYPDIVWKEGHHKNDPLKKQKYPIIKDRRYAKDTFLFHCPVTCNFKAQGIPRFNDKVNTFLKNNPDVNILGIDRGERHLAYWTLINQKREIIKQGSFNNPQGKKDYHDLLDIREKERDKARKSWSTIEKIKDLKAGYLSLLVHKIAKMVEEHNAIVVFEDLNFGFKRGRFKVEKQIYQKLEKALIDKLNYLVFKDKNTAEAGGVLNGLQLTAPFESFQKMGKQTGVVFYVPAYHTSKVCPATGFVNLLYPRYETIKKSQEFFKNFCEIKFNSQEDYFEFSFNYEKFTKKAEGSRQNWTLYTYGERLENYRNSLQNNQWDTREVKLTEAFKKLFNQYVIDFNDGTDIKDQIVRQTEGKFFRQLTHLLKLTLQLRNSRINSDEDWMISPVRGNNGTFFDSRKEDSKMPENADANGAYHIGLKGLWVLEQINNQEEGKKLSIAITNKEWYQFIQDKKYQE

SEQ ID NO: 1041 - protein, 1034 aa, synthetic construct
MIKEQIRKVRSCKLEELYKQILSDRSIISFRLNEIKNDGELCQLIQNLFRINFNNEIVCKKEIIDKETAEIIEEVNISEHLENSFRHISEADPDQLYIRNDRALTDISQAIFGNWSLIGNSLKFYAEKEELGKNKNGIPKKLTSKEQEMWLKHNYFSFGTIHKALQSYFNQFDANELDKEPSDAQNSANAITVETKELAENKPLFEYFKSFETSKKNKETNAFEKVSLLKSVKSAFQPALEMLKKYENEGGEKLKNEKTDVEKIKIYLDALMDLLHFLKPLYVELSRKEEMKAEVFEKDTGFYDDFDKAYNTLKQIIPLYNQTRNHLTKKPFSVEKYKLNFDRSTLAAGWDKNKETANTAVILIKDGKYFLAIMTKEYNKLFQTEPHINTAPAYKKMDYKLLPGASKMLPKVFFSNKNIDYYNPSKEVLHIRNHGTHTKNGRPQKGFTKQDFTKKDCHTMVNFYKNSISRHAEWKEFNFEFSQTNSYNTIDEFYREVEQKGYKITFSDISESYINQCVKEGKLYLFEIYSKDFSKHSKGKPNLQTLYWKEIFSERNLKNVVYKLNGEAELFFRKASIQYPDIVWKEGHHKNDPLKKQKYPIIKDRRYAKDTFLFHCPVTCNFKAQGIPRFNDKVNTFLKNNPDVNILGIDRGERHLAYWTLINQKREIIKQGSFNNPQGKKDYHDLLDIREKERDKARKSWSTIEKIKDLKAGYLSLLVHKIAKMVEEHNAIVVFEDLNFGFKRGRFKVEKQIYQKLEKALIDKLNYLVFKDKNTAEAGGVLNGLQLTAPFESFQKMGKQTGVVFYVPAYHTSKVCPATGFVNLLYPRYETIKKSQEFFKNFCEIKFNSQEDYFEFSFNYEKFTKKAEGSRQNWTLYTYGERLENYRNSLQNNQWDTREVKLTEAFKKLFNQYVIDFNDGTDIKDQIVRQTEGKFFRQLTHLLKLTLQLRNSRINSDEDWMISPVRGNNGTFFDSRKEDSKMPENADANGAYHIGLKGLWVLEQINNQEEGKKLSIAITNKEWYQFIQDKKYQE

SEQ ID NO: 1042 - protein, 1466 aa, synthetic construct
MSENLFSHFTQQYSLIKTLRFSLIPILTEKQEKDIFYQKGYKNRDQIQRQDKIEKFFNENKQDVFEVDIERKKRYRALKYYLTELHKLFIKDALGKAKVNDSLNFSSLFEKYKDFEKEKDDNKKSQLAKGINEEKARLVKFFGNKDGKGGLFQKTAEDYYDWLKDNLNENEKIQDNKDEKQKKNNILLSQNVLLILAKKIKNDNIKEKVKNDKDGNNLYALNNIEYLKKEELRKGTLTEYFQGWSTYFKNFNRIRGNLYKDDGRKVDEGDIENDIKIRKANAGQITTRILDENFEIFVMNSIWAETNKKNLKTEDFQNKDIEDGISIFTPEFYVHCLLQTDINTYNAKIVELNKFFNENKKPNSDIKYLKTLQKQLLLTDKPDGEEDYFVYEILDDDELIKGLEEFSTLSREKIKGIKTFLQGKIEYNLEDIQLNENQLHYFCNKYFGSWSYIRDLYYQQNNIVDEDQAKKDSEFKDKEGISKVAISLLEIKELLNKETVENFIETIKNGWFCRDYKYPSKTNIDLLKNAGVYKEESGNFENFLSFLKFELDSLLNGRAFLTKREQEDKEKIKATKQSLKNSQKERERVDELLLNKFSEENFTQDIADSFEKKQEKFESAFTDLKKAIENKQKLQRAKDFECKKAINEYCTRISDINRYFALFSVPEGVTSGFLNTVVTEFKEDNQIVPLFNAIRNYITKRPEETEKVKLNFDYNNLLDGWVYKNSDHPASSDYHCRLFRKNDSIFLGIVGDAENNLIDSSYELMDYYQIKGQTIFGSTYAGLFNENKYTQDRQEKSNKELLNNIDKIIDEKLIAAFPKAETYIKKIKKDRTSGLFDFEITREQIDRLFTGKTGTTYDEYRKADKKKVVLEILRKNFRNIFNFNEEADYLVNKIGELFGKTPKRKDFKGVDKMVYELTKLEPFFYKISFNAVKQNSNDTKIKALFQIYSKDFSPDKNPNSKKNLHTLYFEELFSKENEENPIFKLSGGAEVFFREKIDDYKVDQWEKKRLKNPKTDKLPNKKRRFTGNQILFHLPIVLNNINDGGSVNRKVHEYIQENEDVKIIGIDRGEKELAYYCLLDQFGTIIDEPKTLNTMGSNVIDGVRQPINYRNKLDIRERERMIARRSWTKIEGIKDLKQGYISNVVNEIAKLMVDNDAFICLEELNHGFKKDRSIRIEKGVYQRLENALVDKLNYLVLEKTPEGVRNARQLTEKNRAIKSWGNQMGALFYTDAKFTSKTCPNCGFRKRGVSDFNNRENLREKIKNGDLKVFFEKKKDRFRIEYNWNYEYRMNNKTELYSNRDLYDQENNMEYIYSDVIRSDWYRKYDPTIKLKEIFKAFYQTSKENIAIKENHFSYSVFIEVFNIILNIRNRTNEEDIISCPKCHFSTLPPKVQKINNGDANGAYNIARKGLMIFEKIRSEKLRKKIYTKKGIESKDLKITLQEWDELTYSQWNKKDWNESNNERGL

SEQ ID NO: 1043 - protein, 1466 aa, synthetic construct
MSENLFSHFTQQYSLIKTLRFSLIPILTEKQEKDIFYQKGYKNRDQIQRQDKIEKFFNENKQDVFEVDIERKKRYRALKYYLTELHKLFIKDALGKAKVNDSLNFSSLFEKYKDFEKEKDDNKKSQLAKGINEEKARLVKFFGNKDGKGGLFQKTAEDYYDWLKDNLNENEKIQDNKDEKQKKNNILLSQNVLLILAKKIKNDNIKEKVKNDKDGNNLYALNNIEYLKKEELRKGTLTEYFQGWSTYFKNFNEIRGNLYKDDGRKVDEGDIENDIKIRKANAGQITTRILDENFEIFVMNSIWAETNKKNLKTEDFQNKDIEDGISIFTPEFYVHCLLQTDINTYNAKIVELNKFFNENKKPNSDIKYLKTLQKQLLLTDKPDGEEDYFVYEILDDDELIKGLEEFSTLSREKIKGIKTFLQGKIEYNLEDIQLNENQLHYFCNKYFGSWSYIRDLYYQQNNIVDEDQAKKDSEFKDKEGISKVAISLLEIKELLNKETVENFIETIKNGWFCRDYKYPSKTNIDLLKNAGVYKEESGNFENFLSFLKFELDSLLNGRAFLTKREQEDKEKIKATKQSLKNSQKERERVDELLLNKFSEENFTQDIADSFEKKQEKFESAFTDLKKAIENKQKLQRAKDFECKKAINEYCTRISDINRYFALFSVPEGVTSGFLNTVVTEFKEDNQIVPLFNAIRNYITKRPEETEKVKLNFDYNNLLRGWVYKNSDHPASSDYHCRLFRKNDSIFLGIVGDAENNLIDSSYELMDYYQIKGQTIFGSTYAGLFNENKYTQDRQEKSNKELLNNIDKIIDEKLIAAFPKAETYIKKIKKDRTSGLFDFEITREQIDRLFTGKTGTTYDEYRKADKKKVVLEILRKNFRNIFNFNEEADYLVNKIGELFGKTPKRKDFKGVDKMVYELTKLEPFFYKISFNAVKQNSNDTKIKALFQIYSKDFSPDKNPNSKKNLHTLYFEELFSKENEENPIFKLSGGAEVFFREKIDDYKVDQWEKKRLKNPKTDKLPNKKRRFTGNQILFHLPIVLNNINDGGSVNRKVHEYIQENEDVKIIGIDRGEKELAYYCLLDQFGTIIDEPKTLNTMGSNVIDGVRQPINYRNKLDIRERERMIARRSWTKIEGIKDLKQGYISNVVNEIAKLMVDNDAFICLEELNHGFKKDRSIRIEKGVYQRLENALVDKLNYLVLEKTPEGVRNARQLTEKNRAIKSWGNQMGALFYTDAKFTSKTCPNCGFRKRGVSDFNNRENLREKIKNGDLKVFFEKKKDRFRIEYNWNYEYRMNNKTELYSNRDLYDQENNMEYIYSDVIRSDWYRKYDPTIKLKEIFKAFYQTSKENIAIKENHFSYSVFIEVFNIILNIRNRTNEEDIISCPKCHFSTLPPKVQKINNGDANGAYNIARKGLMIFEKIRSEKLRKKIYTKKGIESKDLKITLQEWDELTYSQWNKKDWNESNNERGL

SEQ ID NO: 1044 - protein, 1466 aa, synthetic construct
MSENLFSHFTQQYSLIKTLRFSLIPILTEKQEKDIFYQKGYKNRDQIQRQDKIEKFFNENKQDVFEVDIERKKRYRALKYYLTELHKLFIKDALGKAKVNDSLNFSSLFEKYKDFEKEKDDNKKSQLAKGINEEKARLVKFFGNKDGKGGLFQKTAEDYYDWLKDNLNENEKIQDNKDEKQKKNNILLSQNVLLILAKKIKNDNIKEKVKNDKDGNNLYALNNIEYLKKEELRKGTLTEYFQGWSTYFKNFNEIRGNLYKDDGRKVDEGDIENDIKIRKANAGQITTRILDENFEIFVMNSIWAETNKKNLKTEDFQNKDIEDGISIFTPEFYVHCLLQTDINTYNAKIVELNKFFNENKKPNSDIKYLKTLQKQLLLTDKPDGEEDYFVYEILDDDELIKGLEEFSTLSREKIKGIKTFLQGKIEYNLEDIQLNENQLHYFCNKYFGSWSYIRDLYYQQNNIVDEDQAKKDSEFKDKEGISKVAISLLEIKELLNKETVENFIETIKNGWFCRDYKYPSKTNIDLLKNAGVYKEESGNFENFLSFLKFELDSLLNGRAFLTKREQEDKEKIKATKQSLKNSQKERERVDELLLNKFSEENFTQDIADSFEKKQEKFESAFTDLKKAIENKQKLQRAKDFECKKAINEYCTRISDINRYFALFSVPEGVTSGFLNTVVTEFKEDNQIVPLFNAIRNYITKRPEETEKVKLNFDYNNLLDGWVYKRSDHPASSDYHCRLFRKNDSIFLGIVGDAENNLIDSSYELMDYYQIKGQTIFGSTYAGLFNENKYTQDRQEKSNKELLNNIDKIIDEKLIAAFPKAETYIKKIKKDRTSGLFDFEITREQIDRLFTGKTGTTYDEYRKADKKKVVLEILRKNFRNIFNFNEEADYLVNKIGELFGKTPKRKDFKGVDKMVYELTKLEPFFYKISFNAVKQNSNDTKIKALFQIYSKDFSPDKNPNSKKNLHTLYFEELFSKENEENPIFKLSGGAEVFFREKIDDYKVDQWEKKRLKNPKTDKLPNKKRRFTGNQILFHLPIVLNNINDGGSVNRKVHEYIQENEDVKIIGIDRGEKELAYYCLLDQFGTIIDEPKTLNTMGSNVIDGVRQPINYRNKLDIRERERMIARRSWTKIEGIKDLKQGYISNVVNEIAKLMVDNDAFICLEELNHGFKKDRSIRIEKGVYQRLENALVDKLNYLVLEKTPEGVRNARQLTEKNRAIKSWGNQMGALFYTDAKFTSKTCPNCGFRKRGVSDFNNRENLREKIKNGDLKVFFEKKKDRFRIEYNWNYEYRMNNKTELYSNRDLYDQENNMEYIYSDVIRSDWYRKYDPTIKLKEIFKAFYQTSKENIAIKENHFSYSVFIEVFNIILNIRNRTNEEDIISCPKCHFSTLPPKVQKINNGDANGAYNIARKGLMIFEKIRSEKLRKKIYTKKGIESKDLKITLQEWDELTYSQWNKKDWNESNNERGL

SEQ ID NO: 1045 - protein, 1466 aa, synthetic construct
MSENLFSHFTQQYSLIKTLRFSLIPILTEKQEKDIFYQKGYKNRDQIQRQDKIEKFFNENKQDVFEVDIERKKRYRALKYYLTELHKLFIKDALGKAKVNDSLNFSSLFEKYKDFEKEKDDNKKSQLAKGINEEKARLVKFFGNKDGKGGLFQKTAEDYYDWLKDNLNENEKIQDNKDEKQKKNNILLSQNVLLILAKKIKNDNIKEKVKNDKDGNNLYALNNIEYLKKEELRKGTLTEYFQGWSTYFKNFNRIRGNLYKDDGRKVDEGDIENDIKIRKANAGQITTRILDENFEIFVMNSIWAETNKKNLKTEDFQNKDIEDGISIFTPEFYVHCLLQTDINTYNAKIVELNKFFNENKKPNSDIKYLKTLQKQLLLTDKPDGEEDYFVYEILDDDELIKGLEEFSTLSREKIKGIKTFLQGKIEYNLEDIQLNENQLHYFCNKYFGSWSYIRDLYYQQNNIVDEDQAKKDSEFKDKEGISKVAISLLEIKELLNKETVENFIETIKNGWFCRDYKYPSKTNIDLLKNAGVYKEESGNFENFLSFLKFELDSLLNGRAFLTKREQEDKEKIKATKQSLKNSQKERERVDELLLNKFSEENFTQDIADSFEKKQEKFESAFTDLKKAIENKQKLQRAKDFECKKAINEYCTRISDINRYFALFSVPEGVTSGFLNTVVTEFKEDNQIVPLFNAIRNYITKRPEETEKVKLNFDYNNLLRGWVYKNSDHPASSDYHCRLFRKNDSIFLGIVGDAENNLIDSSYELMDYYQIKGQTIFGSTYAGLFNENKYTQDRQEKSNKELLNNIDKIIDEKLIAAFPKAETYIKKIKKDRTSGLFDFEITREQIDRLFTGKTGTTYDEYRKADKKKVVLEILRKNFRNIFNFNEEADYLVNKIGELFGKTPKRKDFKGVDKMVYELTKLEPFFYKISFNAVKQNSNDTKIKALFQIYSKDFSPDKNPNSKKNLHTLYFEELFSKENEENPIFKLSGGAEVFFREKIDDYKVDQWEKKRLKNPKTDKLPNKKRRFTGNQILFHLPIVLNNINDGGSVNRKVHEYIQENEDVKIIGIDRGEKELAYYCLLDQFGTIIDEPKTLNTMGSNVIDGVRQPINYRNKLDIRERERMIARRSWTKIEGIKDLKQGYISNVVNEIAKLMVDNDAFICLEELNHGFKKDRSIRIEKGVYQRLENALVDKLNYLVLEKTPEGVRNARQLTEKNRAIKSWGNQMGALFYTDAKFTSKTCPNCGFRKRGVSDFNNRENLREKIKNGDLKVFFEKKKDRFRIEYNWNYEYRMNNKTELYSNRDLYDQENNMEYIYSDVIRSDWYRKYDPTIKLKEIFKAFYQTSKENIAIKENHFSYSVFIEVFNIILNIRNRTNEEDIISCPKCHFSTLPPKVQKINNGDANGAYNIARKGLMIFEKIRSEKLRKKIYTKKGIESKDLKITLQEWDELTYSQWNKKDWNESNNERGL

SEQ ID NO: 1046 - protein, 1466 aa, synthetic construct
MSENLFSHFTQQYSLIKTLRFSLIPILTEKQEKDIFYQKGYKNRDQIQRQDKIEKFFNENKQDVFEVDIERKKRYRALKYYLTELHKLFIKDALGKAKVNDSLNFSSLFEKYKDFEKEKDDNKKSQLAKGINEEKARLVKFFGNKDGKGGLFQKTAEDYYDWLKDNLNENEKIQDNKDEKQKKNNILLSQNVLLILAKKIKNDNIKEKVKNDKDGNNLYALNNIEYLKKEELRKGTLTEYFQGWSTYFKNFNRIRGNLYKDDGRKVDEGDIENDIKIRKANAGQITTRILDENFEIFVMNSIWAETNKKNLKTEDFQNKDIEDGISIFTPEFYVHCLLQTDINTYNAKIVELNKFFNENKKPNSDIKYLKTLQKQLLLTDKPDGEEDYFVYEILDDDELIKGLEEFSTLSREKIKGIKTFLQGKIEYNLEDIQLNENQLHYFCNKYFGSWSYIRDLYYQQNNIVDEDQAKKDSEFKDKEGISKVAISLLEIKELLNKETVENFIETIKNGWFCRDYKYPSKTNIDLLKNAGVYKEESGNFENFLSFLKFELDSLLNGRAFLTKREQEDKEKIKATKQSLKNSQKERERVDELLLNKFSEENFTQDIADSFEKKQEKFESAFTDLKKAIENKQKLQRAKDFECKKAINEYCTRISDINRYFALFSVPEGVTSGFLNTVVTEFKEDNQIVPLFNAIRNYITKRPEETEKVKLNFDYNNLLDGWVYKRSDHPASSDYHCRLFRKNDSIFLGIVGDAENNLIDSSYELMDYYQIKGQTIFGSTYAGLFNENKYTQDRQEKSNKELLNNIDKIIDEKLIAAFPKAETYIKKIKKDRTSGLFDFEITREQIDRLFTGKTGTTYDEYRKADKKKVVLEILRKNFRNIFNFNEEADYLVNKIGELFGKTPKRKDFKGVDKMVYELTKLEPFFYKISFNAVKQNSNDTKIKALFQIYSKDFSPDKNPNSKKNLHTLYFEELFSKENEENPIFKLSGGAEVFFREKIDDYKVDQWEKKRLKNPKTDKLPNKKRRFTGNQILFHLPIVLNNINDGGSVNRKVHEYIQENEDVKIIGIDRGEKELAYYCLLDQFGTIIDEPKTLNTMGSNVIDGVRQPINYRNKLDIRERERMIARRSWTKIEGIKDLKQGYISNVVNEIAKLMVDNDAFICLEELNHGFKKDRSIRIEKGVYQRLENALVDKLNYLVLEKTPEGVRNARQLTEKNRAIKSWGNQMGALFYTDAKFTSKTCPNCGFRKRGVSDFNNRENLREKIKNGDLKVFFEKKKDRFRIEYNWNYEYRMNNKTELYSNRDLYDQENNMEYIYSDVIRSDWYRKYDPTIKLKEIFKAFYQTSKENIAIKENHFSYSVFIEVFNIILNIRNRTNEEDIISCPKCHFSTLPPKVQKINNGDANGAYNIARKGLMIFEKIRSEKLRKKIYTKKGIESKDLKITLQEWDELTYSQWNKKDWNESNNERGL

SEQ ID NO: 1047 - protein, 1466 aa, synthetic construct
MSENLFSHFTQQYSLIKTLRFSLIPILTEKQEKDIFYQKGYKNRDQIQRQDKIEKFFNENKQDVFEVDIERKKRYRALKYYLTELHKLFIKDALGKAKVNDSLNFSSLFEKYKDFEKEKDDNKKSQLAKGINEEKARLVKFFGNKDGKGGLFQKTAEDYYDWLKDNLNENEKIQDNKDEKQKKNNILLSQNVLLILAKKIKNDNIKEKVKNDKDGNNLYALNNIEYLKKEELRKGTLTEYFQGWSTYFKNFNEIRGNLYKDDGRKVDEGDIENDIKIRKANAGQITTRILDENFEIFVMNSIWAETNKKNLKTEDFQNKDIEDGISIFTPEFYVHCLLQTDINTYNAKIVELNKFFNENKKPNSDIKYLKTLQKQLLLTDKPDGEEDYFVYEILDDDELIKGLEEFSTLSREKIKGIKTFLQGKIEYNLEDIQLNENQLHYFCNKYFGSWSYIRDLYYQQNNIVDEDQAKKDSEFKDKEGISKVAISLLEIKELLNKETVENFIETIKNGWFCRDYKYPSKTNIDLLKNAGVYKEESGNFENFLSFLKFELDSLLNGRAFLTKREQEDKEKIKATKQSLKNSQKERERVDELLLNKFSEENFTQDIADSFEKKQEKFESAFTDLKKAIENKQKLQRAKDFECKKAINEYCTRISDINRYFALFSVPEGVTSGFLNTVVTEFKEDNQIVPLFNAIRNYITKRPEETEKVKLNFDYNNLLRGWVYKRSDHPASSDYHCRLFRKNDSIFLGIVGDAENNLIDSSYELMDYYQIKGQTIFGSTYAGLFNENKYTQDRQEKSNKELLNNIDKIIDEKLIAAFPKAETYIKKIKKDRTSGLFDFEITREQIDRLFTGKTGTTYDEYRKADKKKVVLEILRKNFRNIFNFNEEADYLVNKIGELFGKTPKRKDFKGVDKMVYELTKLEPFFYKISFNAVKQNSNDTKIKALFQIYSKDFSPDKNPNSKKNLHTLYFEELFSKENEENPIFKLSGGAEVFFREKIDDYKVDQWEKKRLKNPKTDKLPNKKRRFTGNQILFHLPIVLNNINDGGSVNRKVHEYIQENEDVKIIGIDRGEKELAYYCLLDQFGTIIDEPKTLNTMGSNVIDGVRQPINYRNKLDIRERERMIARRSWTKIEGIKDLKQGYISNVVNEIAKLMVDNDAFICLEELNHGFKKDRSIRIEKGVYQRLENALVDKLNYLVLEKTPEGVRNARQLTEKNRAIKSWGNQMGALFYTDAKFTSKTCPNCGFRKRGVSDFNNRENLREKIKNGDLKVFFEKKKDRFRIEYNWNYEYRMNNKTELYSNRDLYDQENNMEYIYSDVIRSDWYRKYDPTIKLKEIFKAFYQTSKENIAIKENHFSYSVFIEVFNIILNIRNRTNEEDIISCPKCHFSTLPPKVQKINNGDANGAYNIARKGLMIFEKIRSEKLRKKIYTKKGIESKDLKITLQEWDELTYSQWNKKDWNESNNERGL

SEQ ID NO: 1048 - protein, 1466 aa, synthetic construct
MSENLFSHFTQQYSLIKTLRFSLIPILTEKQEKDIFYQKGYKNRDQIQRQDKIEKFFNENKQDVFEVDIERKKRYRALKYYLTELHKLFIKDALGKAKVNDSLNFSSLFEKYKDFEKEKDDNKKSQLAKGINEEKARLVKFFGNKDGKGGLFQKTAEDYYDWLKDNLNENEKIQDNKDEKQKKNNILLSQNVLLILAKKIKNDNIKEKVKNDKDGNNLYALNNIEYLKKEELRKGTLTEYFQGWSTYFKNFNRIRGNLYKDDGRKVDEGDIENDIKIRKANAGQITTRILDENFEIFVMNSIWAETNKKNLKTEDFQNKDIEDGISIFTPEFYVHCLLQTDINTYNAKIVELNKFFNENKKPNSDIKYLKTLQKQLLLTDKPDGEEDYFVYEILDDDELIKGLEEFSTLSREKIKGIKTFLQGKIEYNLEDIQLNENQLHYFCNKYFGSWSYIRDLYYQQNNIVDEDQAKKDSEFKDKEGISKVAISLLEIKELLNKETVENFIETIKNGWFCRDYKYPSKTNIDLLKNAGVYKEESGNFENFLSFLKFELDSLLNGRAFLTKREQEDKEKIKATKQSLKNSQKERERVDELLLNKFSEENFTQDIADSFEKKQEKFESAFTDLKKAIENKQKLQRAKDFECKKAINEYCTRISDINRYFALFSVPEGVTSGFLNTVVTEFKEDNQIVPLFNAIRNYITKRPEETEKVKLNFDYNNLLRGWVYKRSDHPASSDYHCRLFRKNDSIFLGIVGDAENNLIDSSYELMDYYQIKGQTIFGSTYAGLFNENKYTQDRQEKSNKELLNNIDKIIDEKLIAAFPKAETYIKKIKKDRTSGLFDFEITREQIDRLFTGKTGTTYDEYRKADKKKVVLEILRKNFRNIFNFNEEADYLVNKIGELFGKTPKRKDFKGVDKMVYELTKLEPFFYKISFNAVKQNSNDTKIKALFQIYSKDFSPDKNPNSKKNLHTLYFEELFSKENEENPIFKLSGGAEVFFREKIDDYKVDQWEKKRLKNPKTDKLPNKKRRFTGNQILFHLPIVLNNINDGGSVNRKVHEYIQENEDVKIIGIDRGEKELAYYCLLDQFGTIIDEPKTLNTMGSNVIDGVRQPINYRNKLDIRERERMIARRSWTKIEGIKDLKQGYISNVVNEIAKLMVDNDAFICLEELNHGFKKDRSIRIEKGVYQRLENALVDKLNYLVLEKTPEGVRNARQLTEKNRAIKSWGNQMGALFYTDAKFTSKTCPNCGFRKRGVSDFNNRENLREKIKNGDLKVFFEKKKDRFRIEYNWNYEYRMNNKTELYSNRDLYDQENNMEYIYSDVIRSDWYRKYDPTIKLKEIFKAFYQTSKENIAIKENHFSYSVFIEVFNIILNIRNRTNEEDIISCPKCHFSTLPPKVQKINNGDANGAYNIARKGLMIFEKIRSEKLRKKIYTKKGIESKDLKITLQEWDELTYSQWNKKDWNESNNERGL

SEQ ID NO: 1049 - protein, 1466 aa, synthetic construct
MSENLFSHFTQQYSLIKTLRFSLIPILTEKQEKDIFYQKGYKNRDQIQRQDKIEKFFNENKQDVFEVDIERKKRYRALKYYLTELHKLFIKDALGKAKVNDSLNFSSLFEKYKDFEKEKDDNKKSQLAKGINEEKARLVKFFGNKDGKGGLFQKTAEDYYDWLKDNLNENEKIQDNKDEKQKKNNILLSQNVLLILAKKIKNDNIKEKVKNDKDGNNLYALNNIEYLKKEELRKGTLTEYFQGWSTYFKNFNRIRGNLYKDDGRKVDEGDIENDIKIRKANAGQITTRILDENFEIFVMNSIWAETNKKNLKTEDFQNKDIEDGISIFTPEFYVHCLLQTDINTYNAKIVELNKFFAENKKPNSDIKYLKTLQKQLLLTDKPDGEEDYFVYEILDDDELIKGLEEFSTLSREKIKGIKTFLQGKIEYNLEDIQLNENQLHYFCNKYFGSWSYIRDLYYQQNNIVDEDQAKKDSEFKDKEGISKVAISLLEIKELLNKETVENFIETIKNGWFCRDYKYPSKTNIDLLKNAGVYKEESGNFENFLSFLKFELDSLLNGRAFLTKREQEDKEKIKATKQSLKNSQKERERVDELLLNKFSEENFTQDIADSFEKKQEKFESAFTDLKKAIENKQKLQRAKDFECKKAINEYCTRISDINRYFALFSVPEGVTSGFLNTVVTEFKEDNQIVPLFNAIRNYITKRPEETEKVKLNFDYNNLLDGWVYKRSDHPASSDYHCRLFRKNDSIFLGIVGDAENNLIDSSYELMDYYQIKGQTIFGSTYAGLFNENKYTQDRQEKSNKELLNNIDKIIDEKLIAAFPKAETYIKKIKKDRTSGLFDFEITREQIDRLFTGKTGTTYDEYRKADKKKVVLEILRKNFRNIFNFNEEADYLVNKIGELFGKTPKRKDFKGVDKMVYELTKLEPFFYKISFNAVKQNSNDTKIKALFQIYSKDFSPDKNPNSKKNLHTLYFEELFSKENEENPIFKLSGGAEVFFREKIDDYKVDQWEKKRLKNPKTDKLPNKKRRFTGNQILFHLPIVLNNINDGGSVNRKVHEYIQENEDVKIIGIDRGEKELAYYCLLDQFGTIIDEPKTLNTMGSNVIDGVRQPINYRNKLDIRERERMIARRSWTKIEGIKDLKQGYISNVVNEIAKLMVDNDAFICLEELNHGFKKDRSIRIEKGVYQRLENALVDKLNYLVLEKTPEGVRNARQLTEKNRAIKSWGNQMGALFYTDAKFTSKTCPNCGFRKRGVSDFNNRENLREKIKNGDLKVFFEKKKDRFRIEYNWNYEYRMNNKTELYSNRDLYDQENNMEYIYSDVIRSDWYRKYDPTIKLKEIFKAFYQTSKENIAIKENHFSYSVFIEVFNIILNIRNRTNEEDIISCPKCHFSTLPPKVQKINNGDANGAYNIARKGLMIFEKIRSEKLRKKIYTKKGIESKDLKITLQEWDELTYSQWNKKDWNESNNERGL

SEQ ID NO: 1050 - protein, 1466 aa, synthetic construct
MSENLFSHFTQQYSLIKTLRFSLIPILTEKQEKDIFYQKGYKNRDQIQRQDKIEKFFNENKQDVFEVDIERKKRYRALKYYLTELHKLFIKDALGKAKVNDSLNFSSLFEKYKDFEKEKDDNKKSQLAKGINEEKARLVKFFGNKDGKGGLFQKTAEDYYDWLKDNLNENEKIQDNKDEKQKKNNILLSQNVLLILAKKIKNDNIKEKVKNDKDGNNLYALNNIEYLKKEELRKGTLTEYFQGWSTYFKNFNEIRGNLYKDDGRKVDEGDIENDIKIRKANAGQITTRILDENFEIFVMNSIWAETNKKNLKTEDFQNKDIEDGISIFTPEFYVHCLLQTDINTYNAKIVELNKFFNENKKPNSDIKYLKTLQKQLLLTDKPDGEEDYFVYEILDDDELIKGLEEFSTLSREKIKGIKTFLQGKIEYNLEDIQLNENQLHYFCNKYFGSWSYIRDLYYQQNNIVDEDQAKKDSEFKDKEGISKVAISLLEIKELLNKETVENFIETIKNGWFCRDYKYPSKTNIDLLKNAGVYKEESGNFENFLSFLKFELDSLLNGRAFLTKREQEDKEKIKATKQSLKNSQKERERVDELLLNKFSEENFTQDIADSFEKKQEKFESAFTDLKKAIENKQKLQRAKDFECKKAINEYCTRISDINRYFALFSVPEGVTSGFLNTVVTEFKEDNQIVPLFNAIRNYITKRPEETEKVKLNFDRNNLLDGWVYKNSDHPASSDYHCRLFRKNDSIFLGIVGDAENNLIDSSYELMDYYQIKGQTIFGSTYAGLFNENKYTQDRQEKSNKELLNNIDKIIDEKLIAAFPKAETYIKKIKKDRTSGLFDFEITREQIDRLFTGKTGTTYDEYRKADKKKVVLEILRKNFRNIFNFNEEADYLVNKIGELFGKTPKRKDFKGVDKMVYELTKLEPFFYKISFNAVKQNSNDTKIKALFQIYSKDFSPDKNPNSKKNLHTLYFEELFSKENEENPIFKLSGGAEVFFREKIDDYKVDQWEKKRLKNPKTDKLPNKKRRFTGNQILFHLPIVLNNINDGGSVNRKVHEYIQENEDVKIIGIDRGEKELAYYCLLDQFGTIIDEPKTLNTMGSNVIDGVRQPINYRNKLDIRERERMIARRSWTKIEGIKDLKQGYISNVVNEIAKLMVDNDAFICLEELNHGFKKDRSIRIEKGVYQRLENALVDKLNYLVLEKTPEGVRNARQLTEKNRAIKSWGNQMGALFYTDAKFTSKTCPNCGFRKRGVSDFNNRENLREKIKNGDLKVFFEKKKDRFRIEYNWNYEYRMNNKTELYSNRDLYDQENNMEYIYSDVIRSDWYRKYDPTIKLKEIFKAFYQTSKENIAIKENHFSYSVFIEVFNIILNIRNRTNEEDIISCPKCHFSTLPPKVQKINNGDANGAYNIARKGLMIFEKIRSEKLRKKIYTKKGIESKDLKITLQEWDELTYSQWNKKDWNESNNERGL

SEQ ID NO: 1051 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNRIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDNPTFLGGWAYKTTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQIIFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1052 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNEIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDNPTFLRGWAYKTTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQIIFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1053 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNEIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDNPTFLGGWAYKRTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQIIFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1054 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNRIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDNPTFLRGWAYKTTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQIIFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1055 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNRIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDNPTFLGGWAYKRTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQIIFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1056 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNEIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDNPTFLRGWAYKRTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQIIFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1057 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNRIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDNPTFLRGWAYKRTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQIIFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1058 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNRIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFAEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDNPTFLGGWAYKRTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQIIFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1059 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNEIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDRPTFLGGWAYKTTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQIIFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1060 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNEIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDNPTFLGGWAYKTTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQILFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1061 - protein, 1490 aa, synthetic construct
MAKEKANKNFNDFKNIFPLSKTRKFSLIPVLNIEQERRICIEKGYSNKDEITRQNRVEKFFKDNNQDIFNVDIERKKRYQALKYYLTELHKLFIKDSLEMIKRNNDINFSNLFELYIGYEASNNEKKRKVIGKINNEKVRLAKYFGDKEGKGGVFQKIAKRYYEYLEKNLRNNEKIKGGDDKQKFADGTKNILISQNVLMILSKKINDGSIREKKEKNQGKENEYAIKFKTKENKDQETNLVEYFGGWSTYFKNFNEIRGNLYKDEGRRQGDEGDDETGEKLVKANSGQLTTRILDENFEIFVKNAFLAEKNKIDLGLTDYQKKNVIANHNIFEPDYYANCLLQADINTYNAAIAELNKLFNEKKGKKKIDYLEPLYKQLLLSDGLEEFENGYINEFNNDSDLIEGLEKFYRHAREKLSIVGNFLKDGLINGDLDSILLKENQTHYYCNIFFGSWSYIRDLYYEQNGIGIKNRPDKKSELKDKDGRTKIEISLAEIKSILDGISKERFQEDIKNAIENAKQRSRSVFDLLGVHGSEKIYKEDKSNFENFVLFFKFYFDSLLNGRNLLTEKEKKDKEKITQIKSFLQKSKTEGERVDELLMSKFSEANYLASINASINKKQEEFENEFKDLRQSINLKKGLSRRKDFECKQAINDYCVRISDINGFFALFSIPEGIVADGDNGIIQKFKDKNEINALFGAIRNYITKKDAGNEKIKVTFDRPTFLGGWAYKTTDYCCRILKKQDNYYLLIIGKEKSKNKNDVSKQINVNSLTGYQMMDYYQQKGQTIFGSVYTGKFDSKYGDDRTKLKNSEFIKRIEQIIDGLNREFCNVQKVKMHLESLKEMIRVGKFNFGITASDFGKAFLGKTEKYYHQYKNKKGILNKEDVIISILKELFGSEMFDYGHEKDYLVNRVKEIMKEDAPKTSFLGSDLLAYEVTKLEPYYYKNNFREMDFKKDGIDEKLLDKELFIFQIYCKDFSLKRGSIIPNPKKDLNTLEFEELFSIENREKPLFRLAGQAEVFFYPQKESYKVERWSKDDLKNPKTDKIPYKKRRYAENQILFHIPIVVNNISNGGNVDRKIHEYIQQRNDVKMLGIDRGERELAYCCLLDGKGAICGDVKSMNIVGSNIKNGIKQPINYQKKLDIREKERLMARRSWTKIESIKDIKRGYDANLMHEITTLMAQENALICLEELNRGFKKDRTRIEKSIYQQFENDLVNKLNYLVIEKSPQGVRNALQLTPPNRAQKTWGNQMGAIFYTDARYTSKTCPNCGFRHRSVGGLKTSQEIKNKIAAKELRISYDKKYDRFRIEYHWNYEFKQNSKQCEFASKDLYNGEMEYIFSDVNRSHWNNNDLKDIFKDYLIENEDLFLLVKNEPKFRYVDFGKVFVSLTWIRHSVKEGDQEYDEISCPKCHFWTRSPKVQKIKDGDANGAYNIARKGLIILDKIRSEKLRNKMNTKNGIKSKGLKINLKEWDEATYSQWDRKDWGESDNKRGL

SEQ ID NO: 1062 - protein, 1315 aa, synthetic construct
MSFERLTNIASISKTLRFRLKPVGKTLENLEKLGKLDKDFERNNFYPILKNIADDYYRQYIRNRLTDLNLDWIKLYYAHELLNSTDKESKKNLTTIQSEYRKILLNILSGELDKNGEKFSKDIVKKNKELYGKLFKKEFILEILPKFVETTNIYNKEYFNGINLYNKFTTRLSNFWRARKNIFTDKDIATGIPFRVVNENFVYFYKNIQVFNKNIKYLEDKLDNLEKNLKSEGIMSIDKSIKDFFNPNGFNYVITQKGIDTYQAIRGGFTKENGEKVQGINEILNLTQQQLRRNPYTKNIKLGVLTKLRKQILEYSESTSFLIDQIEDDNDLVDRINKFNVSFFESTEVSPSIFVQLENLYNSLRTANSEDIYIDARNTQKFSQMLFGQWDVIRRGYSLKITEGTKEEKKKYKKYIELDETSKAKGYLTLMEIQELVSSVEGYEEIDVFNVLLEKFKINIIERLKVETPIYGSPMKLEAIKEYLEKHLEEYHKWKLLLINNDELDLDEAFYPLLNEVISDYNIIQLYNLTRNYLTRKYSDKEKIKINFDFPTLADGWSESKISDNRSIILRKDGNYYLGILEDNKLLDNNITNFLENCYEIMKYNLFPDAAKMIPKCSISKKEVKNHFENGEDKSIYLSNQFVGRLEISKELYELQNNLVDGKKKYQIDYLRNTDDKVGYRNALNQWITFCKKFLNKYQGTQDFDYSKLKEAKYYDKLDQFYADVDSYGYSLDFDTINEDLVNKAVEDGKLLLFQIYNKDFSPESKGKKNLHTLYWLSMFSDENLKARKLKLNGQAEIFYRKKLEKKPIIHKEGSILLNKIDKDGNTIPENIYHECYRYLNKKIGRKDLSDKAITLFNKDVLNYKEARFDIIKDRRYSESQFFFHVPITFNWDLKSNQNVNSIVQNMIKDREIKHIIGIDRGERHLLYYSVIDLEGNIVEQGSLNTLNQNRFDNSIVEVDYQDKLRTREEDRDRARKNWTNINKIKELKDGYLSHVVHKLSKLIIDYEAIVILENLNQGFKRGRFKVERQVYQKFELALMNKLSALSFKETYDEGKNLEPSGILNPIQACYPVDSYQDLQGQNGIVFYLPAAYTSVIDPVTGFTNLFRLNSINTTKYEEFIKGFKNIYFDNEDLDFKFIFDYKNFEKFNFVSFKNKKSKKWIVSTRGERISYNSKKKEYFYVKPTEILKNKLIELGINFEDKDKDIISLIDKINDSKKIKLLKVVFDAFKYSVQLRNHDNIQDYIISPVADENGNYYNSNDVAIKNLKLPDNGDANGAFNIARKGLLLIERISNSDDSKVDLKIKNEDWIDFIIS

SEQ ID NO: 1063 - protein, 1354 aa, unidentified
MKAKYMNYQLLFQKFVHLYPISKTLRFELIPQGATQKFITEKQVLLQDEVRARKYPEMKQAIDGYHKDFIQRALGNIDSQSFEQALQTFQELFLRSQAERSTEAYKKEFETTQTKLRELIVNSFEKGEFKQEYKSLFDKNLITNLLKPWVEKQSQTGDNNYTYHNDFNKFTTYFLGFHDNRKNIYSKEPHKTALAYRLIHENLPKFLENNKILRKIQNDHPALWEQLQALHHTMPQLFNGWDLSQLLQVSFFSNTLTQTGIDQYNTIIGGISEGENRQKIQGINELINLYNQKQDKKNRVAKLKQLYKQILSDRSTLSFLPQQFADDAELYHAINMFYLDHLHYQSMVNGHSYTLLERVQLLINELANYDLSKVYLAPNQLSAVSHQMFGDFGYISRALSYYYMQVIQPDYELLLASAKTTAKIEAIEKLKTAFLDAPHSLVVIQAAIDKYLQLQPSSKPHTQLTDFIISLLKQYETVADDQSIKIINIFSDIEGKYSCIKGLVNTESTSESKREILQNEKLATDIKAFMDAINNVIKLLKPFALNEKLAASVEKDARFYSDFEEIYQALLVFVPLYNKVRNYITQKPYSTEKFKLNFNKPTLLSGWDANKEADNLSILLRKNGNYYLAIMDTAKGANKAFEPKALNQLKVDDTTDCYEKMVYKLLPGPNKMFPKVFFSESRKAQFNPPQHIIESYNKKEHISSEAHFDLKKCHALIDWFKQCIELHEDWKHFNFKFSPTSQYSNISDFYKEVSEQNYKVHFQDIPADYIEQLVAEGKLYLFQIYNKDFSPHAKGKENLHTMYFKALFSEENLKQPVFKLSGEAEMFYRPASLQLENTTIHKAGEAMVAKNPLTPDATRTLAYDIIKDRRFTTDKYLLHIPISLNFHAQESMSIKKHNDLVRQMIKHNHQDLHIIGIDRGEKHLLYVSVIDLKGNIVYQESLNSIKSEAQNFETPYHQLLQHREEGRAQARTAWGKIENIKELKDGYLSQVVHRIQQLILKYNAIVMLEDLNFGFKRGRFKIEKQIYQKFEKALIHKLNYVVDKSTQADELGGVRKAYQLTAPFESFEKLGKQSGVLFYVPAWNTSKIDPVTGFVDLLKPKYENLDKAQAFFKTFDSIIFNAKKDYFEFKVNLNQFAGLKAQAARAEWTICSYGPERHVYQKKNAQQGETVIVNVTEELKALFAKNNIEVAEGVELKEMICAQTQVDFFKRLIWLLQVLLALRYSSSKDKLDYILSPVANVLGEFFDSRHASTHLPQDSDANGAYHIALKGLWVIEQLKTAANTEKVNLAISNDEWLRFAQEKLYLTTSKRPAATKKAGQAKKKKSRYPYDVPDYAYPYDVPDYAYPYDVPDYA

SEQ ID NO: 1064 - protein, 1228 aa, unidentified
MKEQFINRYPLSKTLRFALIPVGETENNFNKNLLLERDKQRAENYEKVKGYIDRFHKEYIESVLSKARIEKVDEYANLYWKSNKDDSDAKAMESLENDMRKQISKQLTSTEIFKKRLFGKELICEDLPAFLTDENEKETVECFKNFTTYFNGFHTNRKNMYSSDGKSTAIAYRCINDNLPRFLDNVKSFQKVFDNLSDETITKLNTDLYNIFGRNIEDIFSVGYFEFVLAQSGIEIYNSMIGGYTCSDKTKIQGLNEYINLYNQQVAKNEKSKRLPLMKPLYKQILSEKDSVSFIPEKFHSDNEVLHAIGDYYNNHIGDFDLLTELLQSLNTYNANGIFVKSGVAITDISNGAFNSWNVLRSAWNEKYEALHPVTSKTKIDKYIEKRDKIYKAIKSFSLFELQSLGNENGNEITDWYVSSINECNSKIKEAYLQAQELLNSDYETSYNKRLYKNEEATELVKNLLDAIKDFQKLIKPLNGTGKEENKDELFYGKFTSHYDSIADIDRLYDKVRNYITQKPYSKDKIKLNFDNPQLLGGWDKNKESDYRTVLLHKDGFYYLAVMGKSHSKVFVDAPEITSYDEDYYEKMEYKLLPGPNKMLPKVFFATKNIDTFQPSDRILDIRKRESFKKGATFNKAECHEFIDYFKESIEKHDDWSQFGFEFSPTESYNDISEFYREISDQGYSVRFNKISKNYIDGLVENGYIYLFKIYNKDFSKYSKGTPNLHTLYFKMLFDDRNLSNVVYKLNGEAEMFYREASINDKEKITYQANQPIENKNPDNEKKESVFEYDIVKDKRFTKRQFSLHLPITINFKAHGQEFLNYDVRKAVKYKDDNYVIGIDRGERNLIYISVINSNGKIVEQMSLNEIISDNGHRVDYQKLLDKKEKERDKARKNWTSVENIKELKEGYISQVVHKICELVVKYDAVIAMEDLNFGFKRGRFPVEKQIYQKFENMLISKLNLLIDKKADPTENGGLLRAYQLTNKFDGVNKAKQNGIIFYVPAWDTSKIDPVTGFVNLLKPKYTSVQEAKNLFETIDDIKYNANTDMFEFYIDYSKFPRCNSDFKKTWTVCTNSSRILTFRNKDKNNMWDNKQIVLTDAFKSLFNEFGIDYKGNLKDSILSISNVDFYKRLIKLLSLTLQMRNSITGSTLPEDDYLISPVANESGEFYDSRNYKGTNAALPCDADANGAYNIARKALWAINVLKDTPDDMLNKAKLSITNAEWLAYTQR

SEQ ID NO: 1065 - protein, 1235 aa, unidentified
MKEQFINRYPLSKTLRFSLIPVRSEEHIPVGETENNFNKNLLLEKDKQRAENYEKVKGYIDRFHKEYIESVLSKARIEKVDEYANLYWKSNKDDPDIKAMESLESDMRKQISKQLKSNARYKRLFGKELICEDLPSFLTDKDERETVECFRSFTTYFKGFNTNRENMYSSDEKSTAIAYRCINDNLPRFLDNVKSFQKAFDNLSDETITKLNTDLYNIFGRNIEDIFSVDYFEFVLAQSGIEIYNSMIGGYTCSDGTKIQGLNEYINLYNQQVAKNEKSKRLPLMKPLYKQILSEKDSVSFIPEKFNSDNEVLLAIEDYYTGHIGDIDLLTELLQLLNIYNANGIFVKSGVAITDISNGAFNSWNVLRSAWNEKYEALHPVTSKTKIDKYIEKQDKVYKATKSFSLFELQSLGNENGNEITDWYISSINECNSKIKEAYLQAQELLKSDYEKSYDKRLYKNEKATELIKNLLDAIKDFQHLVKPLNGTGKEENKDELFYGKFTSYYDSVADIDKLYDRVRNYITKKPYSKDKIKLNFDNPQLLGGWDKNKESDYRTVLLHKDGLYYLAVMVKSHSKAFVDAPEITSDDEDYYEKMEYKLLPGPNKMLPKVFFATKNIDTFQPSDRILDIRKRESFKKGATFNKAECHEFIDYFKESIEKHDDWSQFGFEFSPTESYNDISEFYREISDQGYSVRFNKISKNYIDGLVENGYIYLFQIYNKDFSKYSKGTPNLHTLYFKMLFDERNLSNVVYKLNGEAEMFYREASIGDKEKITHYANQPIENKNPDNEKKESVFEYDIVKDKRFTKRQFSLHVPITINFKAHGQEFLNNDIRKAIKYKDDNYVIGIDRGERNLIYISVINSNGKIVEQMSLNKIISDNGYRVDYQKLLDAKEDKRDKARKNWTSVENIKELKEGYISQVVHKICELVVKYDAVIAMEDLNFGFKRGRFPVEKQVYQKFENMLISKLNLLIDKKAEPTENGGLLRAYQLTNKFDGVNKAKQNGIIFYVPAWDTSKIDPATGFVNLLKPKYTSVPEAKKLFETIDDIKYNATTDMFEFYIDYSKFPRCNSDFKKAWTVCTNSSRILTFRNKEKNNMWDNKQIVLTDEFKSLFNEFGIDYKGNLKDSILSISNVDFYKRLIKLLSLTLQMRNSITGSTLPEDDYLISPVANENGEFYDSRNYKGTNAALPCDADANGAYNIARKALWAINVLKDTPDEMLNNAKLSITNAEWLEYTQR

SEQ ID NO: 1066 - protein, 1227 aa, unidentified
MKEQFINRYPLSKTLRFSLIPVGETENNFNKNLLLEKDKQRAENYEKVKGYIDRFHKEYIESVLSKARIEKVDEYANLYWKSNKDDSDIKAMESLENDMRKQISKQFTSIEIYKRLFEKELICEDLPAFLTDKDERETVECFRSFTTYFKGFNTNRKNMYSSDEKSTAIAYRCINDNLPRFLDNVKSFQKVLNNLSDETVTKLNTDLYNIFGRNIEDIFSVDYFEFVLAQSGIEIYNSMIGGYTCSDGTKIQGLNECINLYNQQVAKNEKSKRLPLMKPLYKQILSEKDSVSFIPEKFNSDNEVLLAIEDYYNSHIGVIDLLTELLQSLNTYNANGIFVKSGVAITDISNGAFNSWNVLRSAWNEKYEALHPITSKTKIDKYIEKRDKIYKAIKSFSLFELQSLGNENGNEITDWYISSINECNSKIKEAYLQAQESLKSDYEKNYNKRLYKNEKSTELVKNLLDAIKEFQHFVKPLNGTSKEENKDELFYGKFTSHYDSIADIDRLYDKVRNYITQKPYSKDKIKLNFDNPQLLGGWDKNKESDYRTVLLHKDGLYYLAVMDKSHSKAFVDAPEIASDDEDYYEKMEYKLLPGPNKMLPKVFFASKNIDTFQPSDRILDIRKRESFKKGATFNKSECHEFIDYFKGSIEKHDDWSQFGFKFSPTESYNDISEFYREISDQGYSVSFNKISKSYVDELVDNGYIYLFQIYNKDFSKYSKGTPNLHTLYFKMLFDERNLSNVVYKLNGEAEMFYREASINDKEKITHQANQPIENKNPDNKKKESTFEYDIVKDKRFTKRQFSLHVPITINFKAHGQEFLNNDVRKAVKYKDDNYVIGIDRGERNLIYISVINSNGKIVEQMSLNEIISDNGHKVDYQKLLDTKEKERDKARKNWTSVENIKELKEGYISQVVHKICELVVKYDAVIAMEDLNFGFKRGRFPVEKQVYQKFENMLISKLNLLIDKKADPTENGGLLRAYQLTNKFDGVNKAKQNGIIFYVPAWDTSKIDPATGFVNLLKPKYTSVPEAKNLFETIDDIKYNANTDMFEFYIDYSKFPRCNSDFKKSWTVCTNSSRILTFPNKEKNNMWDNKQIVLTDEFKSLFNEFGIDYKGNLKDSILSISNADFYGRLIKLFSLTLQMRNSITGSTLPEDDYLISPVANESGEFYDSRNYKGTNAALPCDADANGAYNIARKALWAINVLKDTPDDMLNKAKLSITNAEWLEYTQR

SEQ ID NO: 1067 - protein, 1229 aa, unidentified
MKEQFINRYPLSKTLRFSLIPVGETENNFNKNLLLKKDKQRAENYEKVKCYIDRFHKEYIESVLSKARIEKVNEYANLYWKSNKDDSDIKAMESLENDMRKQISKQLTSTEIYKKRLFGKELICEDLPSFLTDKDERETVECFRSFTTYFKGFNTNRENMYSSDGKSTAIAYRCINDNLPRFLDNVKSFQKVFDNLSDETITKLNTDLYNIFGRNIEDIFSVDYFEFVLTQSGIEIYNSMIGGYTCSDKTKIQGLNECINLYNQQVAKNEKSKKLPLMKPLYKQILSEKDSVSFIPEKFNSDNEVLHAIDDYYTGHIGDFDLLTELLQSLNTYNANGIFVKSGVAITDISNGAFNSWNVLRSAWNEKYEALHPVTSKTKIDKYIEKQDKIYKAIKSFSLFELQSLGNENGNEITDWYISSINESNSKIKEAYLQAQKLLNSDYEKSYNKRLYKNEKATELVKNLLDAIKEFQKLIKPLNGTGKEENKDELFYGKFTSYYDSIADIDRLYDKVRNYITQKPYSKDKIKLNFDNPQLLGGWDKNKESDYRTVLLHKDGLYYLAVMDKSHSKAFVDAPEITSDDKDYYEKMEYKLLPGPNKMLPKVFFASKNIDTFQPSDRILDIRKRESFKKGATFNKAECHEFIDYFKDSIKKHDDWSQFGFKFSPTESYNDISEFYREISDQGYSVRFNKISKNYIDGLVNNGYIYLFQIYNKDFSKYSKGTPNLHTLYFKMLFDERNLSNVVYKLNGEAEMFYREASIGDKEKITHYANQPIKNKNPDNEKKESVFEYDIVKDKRFTKRQFSLHLPITINFKAHGQEFLNYDVRKAVKYKDDNYVIGIDRGERNLIYISVINSNGEIVEQMSLNEIISDNGHKVDYQKLLDTKEKERDKARKNWTSVENIKELKEGYISQVVHKICELVIKYDAVIAMEDLNFGFKRGRFPVEKQVYQKFENMLISKLNLLIDKKAEPTEDGGLLRAYQLTNKFDGVNKAKQNGIIFYVPAWDTSKIDPATGFVNLLKPKCNTSVPEAKKLFETIDDIKYNANTDMFEFYIDYSKFPRCNSDFKKSWTVCTNSSRILTFRNKEKNNKWDNKQIVLTDEFKSLFNEFGIDYKGNLKDSILSISNADFYRRLIKLLSLTLQMRNSITGSTLPEDDYLISPVANKSGEFYDSRNYKGTNAALPCDADANGAYNIARKALWAINVLKDTPDDMLNKAKLSITNAEWLEYTQK

SEQ ID NO: 1068 - protein, 1227 aa, unidentified
MKEQFINCYPLSKTLQFSLIPVGKTEDNFNKNLLLEKDKQRAENYEKVKGYIDRFHKEYIESVLSKARIEKVNEYADLYWKSNKDDSDTKAMESLENDMRKQISKQLKSGARYKRLFGKELICEDLPAFLTDENEKETVECFRSFTTYFKGFNTNRENMYSSDEKSTAIAYRCINDNLPRFLDNIKSFQKVFDNLSDKTITKLNTDLYNIFGRNIEDIFSVDYFEFVLTQSGIEIYNSMIGGYTCSDKTKIQGLNEYINLYNQQVAKNKKSKRLPLMKPLYKQILSEKDSVSFIPEKFNSDNEVLHAIGDYYNNHIGDFDLLTELLQSLNTYNANGIFVKSGVAITDISNGAFNSWNVLRSAWNEKYEALHPVTSKTKIDKYIEKQDKIYKAIKSFSLFELQSLGNENGNEITDWYISSINECNSKIKEAYLQAQELLNSDYEKSYDKRLSKNEKATELVKNLLDAIKEFQQLVKPLNGNGKEENKDELFYGKFASLYDSIADIDRLYDKVRNYITQKPYSKNKIKLNFDNPQLLGGWDKNKESDYRTVLLRKDDLYYLAVMGKSHSKAFANAPEITSYDEDFYEKMEYKLLPGPNKMLPKVFFATKNIDTFQPSDRILNIRKRESFKKGATFNKSECHQFIDYFKESIEKHDDWSQFGFKFTPTESYNDISEFYREISDQGYSVSFNKLSKSYVDELVENGYIYLFQIYNKDFSKYSKGTPNLHTLYFKMLFDDRNLSNVVYKLNGEAEMFYREATIGDKEKITHYANQPIKNKNPDNEKKESTFEYDIIKDNRFTKRQFSLHLPITINFKAHGQEILNYDVRKAVKYKNDNYVIGIDRGERNLIYISVINSNGKIVEQMSLNEIISDNGHKVDYQKLLDTKEKERDKARKNWTSVENIKELKEGYISQVVHKICELVVKYDAVIAMEDLNFGFKRGRFPVEKQVYQKFENMLISKLNLLIDKKADPTEDGGLLRAYQLTNKFDGVNKAKQNGIIFYVPAWDTSKIDPATGFVNLLKPKYTSVPEAKKLFETIDDIKYNANTDMFEFCIDYGKFPRCNSDFKKSWTVCTNSSRILTFRNKEKNNMWDNKQIVLTDEFKSLFNEFGINYKGNLKDSILSISNADFCKRLIKLLSLTLQMRNSITGSTLPEDDYLISPVANENGEFYDSRNYKGTTSALPCDADANGAYNIARKALWAINVLKDTPDDMLNKAKLSITNAEWLEYTQR

SEQ ID NO: 1069 - protein, 1187 aa, unidentified
MSKLFENMTNLYSLNKTLRFELKPVGNTRELIESKDFFKNDEEKAENYQFMKEKMDKIHRNYIQKSLETIKMLPILDQTEQKRLKKEDIKNELKSLRSFISAAFVSVKDLLSNKIIEWLISEASIEEKEKIKKFDKFFGYFKTYVQNRGNLYKAEDKAGQIAFRLIDENLPRFFKAKQIIEEIIKKTPDFVVKERNEKQEETEKKITEYLSIFYLNSYCHYLSQSGIDLFNEIVGHINLSINLYKQKTGVKFSLIPLLYKLPLAPRKQISRLPKQIENPEELELIVKSVLDRIDQKINPFINNILQTVLEENSVYDLNWIYISIKTTEQWWSIGLSGRNSLRELGYNQSKNWEEPVLKAEKNKFPFISLGEIKSFLDAKQLAWDDIKSVFWEGKSQSLMNWSWSNIFFHLIGKEISSLIEKYLHSRKNYQISQSKENQKHVLDNSLSLWRLLGWFVLMHKKTHLTPEIKESFFYDWENGLDAIVFDENSDPIHTIYDKVRNCLTKKPYSNKDKIKVNFDCPYLLWGWDQNYDAFGWLIFHDWKKYFLWLIKGSWLNMEEKNKLYEWINPMNSITKIIYDYQKPDFKNVPRLFIRSKWDTFAPMVREYWLPVNDILYLYDNELYKPDKKNPWKHKSYLRRLIDYFKLWLSKHKSFKHYIFKRKESDQYENLAEFYSDVEFSCYAIKKEKVNFDQVKALCESERLYLFEIYNKDYNQFSKWKNKNLHTQYFEALFEERDNNLFMLSGGWSIFWRESNWKIVEKIRSYSPKYNIEIIDKRRYTKNKLMIHIPIVLNFCRNQEWRVNDMIKSLIQSQSNNFTILGIDRWEKHLLYYSLIRQDWTIIKTGSRNTITNKIKIVDYHKKLDDREKKRDEAQANWEQQEQIKDLKKWYISQVINEISKMIIEHNAIIVLEDLNGWFKRWRQKVEKSIYQQFELALAKKLNHLVFKNRWDTESWGTMKAYQLTPLVAQFQDLSFQTWVVFYTPAWYTSTTCPCCGWRKNIYFKYENEKQAKIELEKLNIVRENNYFSITYTAEWWNKKWKITWSVLNKTDRILTTKWQTRLQYDRASKNTKEYDITTDFNSVFTAKFLDYKIRLENAGSKQCRNLINSINLLLKIRNAKSGTDIDTIQCPACEFHSQWWFQWNEFNWDANWAYNIARKGKVIIDKIVKGEKNTTVSQIEFDNEIQK

SEQ ID NO: 1070 - protein, 1238 aa, unidentified
MSNFSDFTGLFSLGKTLRFELKPIGKTLENIEKKGLLAEDEKRAESYKKVKKLIDEYHKTFIENALSNLTEKEKDGLKKLLDEYFECYNSNRKDELVTCVADLRKHIAGIFKNENNKATFERIFGKELIREDLIKAVKSDEERKLIGEFNDFTTYFTGFNENRKNMYSAEEKSTAIAYRLINENLPKFIDNMKIFEKITQIDEIRSNIEELQKNLSSELNGAKVAEFFELSFYGSLLTQTQIETYNLILGGKSPKQGEKTKGLNEYINLYNQQQSEKKDRLPKFKPLFKQILSDRNAFSWIPEAFVSDNEVLEQIQKCYTELNSEEVDFFGNLRRLLKRTGDFDLKTIYISNDLQLTNISQQMFGSYAVIPNAIEEWFKRNNPPKSKEKAEKYEERIKKMTNAESYSIGFINECLKEAGEEKGVDQYFANCGEPENSRNDLLAEISKQYLNTRDLLNCSYPEGNKLAADKQNVEKIKNFLDAIKDLQRFVKPLVGSGTESDKNAEFYGEFSPLYENFNNFTLLYNKVRNYLTRKPYSTEKIKLNFKNSTLLNGWDLNKESDNTCVLLRKDGMYYLGIMDKNNNKIFASKEIKSDGDCYEKMVYKLLPGPNKMLPKVFFAASRINEFAPSDEILEIRKKETFKKGPNVKPEDLRKWINFMKESLRKNKDWQDFDFHFSDTSSYEDISQFYREVEQQGYKISFVNVSTSYINQLVDEGKLYLFQIYNKDFSSYSKGTPNIHTLYWRMLFDSSNLKDVVYKLNGEAEVFFRKKSITYNDEIQKHGHHYTELKDKFAYPIIKDRRYSLDKFQFHVPMTINFKAGNRDNINALVCDYIKESDDLNIIGIDRGERNLLYVTVIDLNGNIKEQISLNEIVSENKYDYRTDYHKLLDNREKERDAARRSWQSVENIKDLKSGYLSQVIHKISQLMIKYKAIVVLEDLNAGFMRGRQKVEKSVYEQFEKKLIDKLNFLVDKQVKDPNEPGGLFHAYQLTGKFESFKKLGKQSGMLFYVPAWNTSKIDPVTGFVNFFNTRYESIEKAKDFFSKFDSICYNPQKDHFEFAFDYKNFTVKAGDSQTKWSVCTIGSRIETFRNEKKNHNWDNREIDLTLEFKKHFETYKIALNSDLKAEIVRQTSKDFFQRLLYLFKLTVQMRNSITNSSTDYLISPVADKNGNHFDSRKSDKTLPQDADANGAYNIARKGLWLIRQIKQFEGSDWKKFKIEPIKNVAWLSFVQEEARKKG

SEQ ID NO: 1071 - protein, 1239 aa, synthetic construct
MKQLNDLTGLYSLSKTLRFELKPIGKTLEHIESKGFITQDEKRAEEYKRVKDIIDRYHKSFITMCLCGFKFNQEDLDTYAALAEDFNRDEKAFEESKKTLRKQIVGAFKKGGGYSDLFKKELIQKHLPEIVTDDEEKKMVENFSKFTTYFTGFNRNRKNMYSDEEKSTAIAYRLIHDNLPMFLDNTRSFSRIADSDVRQSFCKIESSFSEYLNVEHLAEMFQLDYFSETLTQEQIAVYNHVVGGRTLEDGTKIQGINEYVNLYNQQHKDNRLPLLKPLYKMILSDRVALSWLPDEFANDKEMIDAIKETYDSLKENLTGDGDGSLRNLLLNINNYDIEHIYIANDLGLTDISQQMFGQYDVYTSAIKQELRNSVTPTAKERREPELYAERINKLFKSTKSFSVAYLNSLVDAEHTIQNYYQQLGAYDRDGEQRINLFTQLEMAYVAAKDILSGKHGNISQTDAEIAIIKNLLDAYKSLQHFIKPLLGNGDEADKDNEFDAKLREVWDALDIVTPLYNKVRNWLTRKPYSTEKIKLNFENAQLLRGWDKNRETDCTSVLLRKDGKYFLAIMDKKANRAFDVEDLPCDGICFEKMNYKQIALPMGLGAFVRKCTGSAKKLGWTCPSSLLNKDMKIIIKDDEATNVLPSLIECYKDFLNIYEKDGFKYKDFNFKFKPTHEYKKLSHFFAEVPTQGYKITFRKVSESFINQLVDEGKLYLFQIWNKDFSEFSKGSPNMHTLYWKMLFDERNLADVVYKLNGQAEVFYRKSSLDVANTTIHKAHQPILNKNQENKKQQSTFDYDIIKNRRYTVDKFQFHVPISINFKATGRDNVNSQVLDIIRNGGIKHIIGIDRGERHLLYLSLIDLKGNIVKQMTLNDIVNEYNGNTYATNYRDLLAEREGNRTEARKNWKKIENIKDIKQGYLSQVVHIISKMMVEYDAIVVLEDLNMGFMRGRQKIERSVYEQFEKMLIDKLNYYVDKQKDVNEAGGLLHALQLTSRFESFKKLGKQSGCLFYIPAWNTSKIDPVTGFVNLFDTRYTNADQARKFFSLFDSIRYNAEKNWFEFAFDYDKFTTKAKGTRTRWTLCTYGTRIRTFRNPAKLNQWDNKEVVLTDEFKKAFADAGIDIHGNLKEAICSLEDKKYLEPLMHLMKLLLQMRNSITNTEVDYLLSPVADKNGSFYDSRVCSYALPKDADANGAYNIARKGLWAIRQIQETPVGERPNLAIKNNEWLKFAQQKPYRDE

SEQ ID NO: 1072 - protein, 1158 aa, synthetic construct
MSKFQNLYTINKTLRFGLKPFGKTLENFNKTNLLQLDEYKAKHRKEVQRLFDENFKQLIEERLRGLSLDTQALEEAFDINKRDAALISLKKQVTGICYDSEMKKTYLQADKHFQKLLAAGPNQAMVCTYDKFSTYFVNFFDIRTHIFKGDTSGSIAYRLIDENLTIFKKNVDKIAKLPVGLKDEVEELADIESLQSYNSYLTQSGITEYNELLGGIAYEDGTKLQGINEKINLYGQKNKLKLPRLESLYKMILSDRETQSFVLSIIENDAELIGQISTLLEDVLLSKTLALSDVDGVFIKYTQLGNLPGVPYTVINSKINEAFDATYTGKKEGEKYKVTKKKTIEKDVYSLSKIEKLFQDSDINVSEALKNKYGVLIASYEEAKGLFNSIDWTEIKNIKQSGHTIIIKDVLDALKNIQFFYNLFDVVEENLNPSIEFYNELSLNKNQLGNEFNSTYNKARNYLTKKEYSEEKFKLNFDSPTLARGWDVNRETANLTILLRRFNSERNNYDYFLGVWKKAVPSREKNLIINADGEFEKMDYKLYPDPSKMLPKQFVSAQSWFDKYPASPEFMGKYEAGLHKKGNNFDIEFLHELINRYKHGLKHHENKYEETFDFELKETEEYSEYSEFIQDVSKSNYKVKFNHVAGVEELVEEGKLYLFQIWSKDFSTFSKGTKNLNTIYFESLFSEENLEKRIFKLSGGAELFYRPKSLTYTKELMEKGHHYNELKDSFNYPIIKDKRYTEDKFMFHVPIQINYGAENLGPVKLNNRINENIDGFTHIIGIDRGERHLVYISVVDVKTGKIVEQKHLDEIVNIDSKGKKHCTPYLQKLDERSKTRDQERKSWEAIETIKELKDGYISQVVNEICTLQQKYNALIVMENLNLGFKRSRFKVEKQIYQKFETALIKKFNYIIDKKDNSTYLHGLQLANPIQTLNSIGKQSGIIFYIPAWNTSKIDPTTGFVNLLYGADLRYTNKEQAEAFINKLDKIYFEDGVFKFDIDFKKWNQRYAKSCTKWTLTSYGTRVETKRDVIKNNMWCSNEIDLTAEFEKILNKRDGSLKTCDVETYKRFLYLFKLLLQIRNSITGTDTDYMISPVIAADGQQFDSRVVGMSLPNGLPKDADANGAYNIARKGLMAVHNIKAGFKKPFEISNEEYLEYLQK

SEQ ID NO: 1073 - protein, 1237 aa, synthetic construct
MHTMKKINELTALYPLSKTLRFELKPIGKTLDHIEQKGLIVQDEQRAEEYKQVKKIIDSYHKEFITMCLKGLKLNMVYLERYESLAREVHRDEAEFDKVKAALRKQIVEAFKQGGSYNDLFKKELIQKHLPEFVESEEEKKMVANFSKFTTYFTGFYENRKNMYSDEEKSTAIAYRLIHENLPLFLDNMRSFRKIAESEVGGHFAKIEVRFEEYLNVEHLAEMFELDYFSDTLTQEQIAVYNSVIGGRTLDDGTKIQGINEYVNLYNQQHKEARLPLLKPLYKMILSDRVALSWLPENPFESDGEMVEAIKEMCQSLKEVLMGNDGLRNLLLNIDLYDIEHIYIANDLGLTDISQQMFGQYDVYASAIKQKLRQGVKQSPKERREPELFEERINRLYKSAKSFSIADLNSHTDANHTIESYFKQLGAYDREGEQRINLFTQIEMAQIEATDILAGKHGNISQSDKEIAILKGLLDAYKSLQHFVKPLLGHGDEADKDNEFDAKLREAWNALDIVTPLYNKVRNWLTRKPYSVEKIKLNFENAQLLRGWDVNREPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDMADTTVHRASQPLVNKNALNKKRHSTFDYDIVKDRRYTVDKFQFHVPMTMNFKAVGRDNINSEVLNIIRNGGIKHIIGIDRGERHLLYLSLIDLRGNIVKQMTLNDIVNEYRGNTYSTNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKARDFFSKFDSIRYNDAKNWFEFAFDYNEFTEKAKDTRTRWTLCTWGTRIRTFRNPAKLNQWDNEEVVLTDVFKKAFDEAGIDIHSNLKEAICILTEKKHLESLMHLMKLLLQMRNSITNSEIDYLLSPVADENGHFYDSRTCDDTLPKDADANGAYNIARKGLWAIRTIQESSETERPNLALKNQDWLRFAQQKPYLND

SEQ ID NO: 1074 - protein, 1237 aa, synthetic construct
MHTMKKINELTALYPLSKTLRFELKPIGKTLDHIEQKGLIVQDEQRAEEYKQVKKIIDSYHKEFITMCLKGLKLNMVYLERYESLAREVHRDEAEFDKVKAALRKQIVEAFKQGGSYNDLFKKELIQKHLPEFVESEEEKKMVANFSKFTTYFTGFYRNRKNMYSDEEKSTAIAYRLIHENLPLFLDNMRSFRKIAESEVGGHFAKIEVRFEEYLNVEHLAEMFELDYFSDTLTQEQIAVYNSVIGGRTLDDGTKIQGINEYVNLYNQQHKEARLPLLKPLYKMILSDRVALSWLPENPFESDGEMVEAIKEMCQSLKEVLMGNDGLRNLLLNIDLYDIEHIYIANDLGLTDISQQMFGQYDVYASAIKQKLRQGVKQSPKERREPELFEERINRLYKSAKSFSIADLNSHTDANHTIESYFKQLGAYDREGEQRINLFTQIEMAQIEATDILAGKHGNISQSDKEIAILKGLLDAYKSLQHFVKPLLGHGDEADKDNEFDAKLREAWNALDIVTPLYNKVRNWLTRKPYSVEKIKLNFENAQLLGGWDVNREPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDMADTTVHRASQPLVNKNALNKKRHSTFDYDIVKDRRYTVDKFQFHVPMTMNFKAVGRDNINSEVLNIIRNGGIKHIIGIDRGERHLLYLSLIDLRGNIVKQMTLNDIVNEYRGNTYSTNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKARDFFSKFDSIRYNDAKNWFEFAFDYNEFTEKAKDTRTRWTLCTWGTRIRTFRNPAKLNQWDNEEVVLTDVFKKAFDEAGIDIHSNLKEAICILTEKKHLESLMHLMKLLLQMRNSITNSEIDYLLSPVADENGHFYDSRTCDDTLPKDADANGAYNIARKGLWAIRTIQESSETERPNLALKNQDWLRFAQQKPYLND

SEQ ID NO: 1075 - protein, 1237 aa, synthetic construct
MHTMKKINELTALYPLSKTLRFELKPIGKTLDHIEQKGLIVQDEQRAEEYKQVKKIIDSYHKEFITMCLKGLKLNMVYLERYESLAREVHRDEAEFDKVKAALRKQIVEAFKQGGSYNDLFKKELIQKHLPEFVESEEEKKMVANFSKFTTYFTGFYENRKNMYSDEEKSTAIAYRLIHENLPLFLDNMRSFRKIAESEVGGHFAKIEVRFEEYLNVEHLAEMFELDYFSDTLTQEQIAVYNSVIGGRTLDDGTKIQGINEYVNLYNQQHKEARLPLLKPLYKMILSDRVALSWLPENPFESDGEMVEAIKEMCQSLKEVLMGNDGLRNLLLNIDLYDIEHIYIANDLGLTDISQQMFGQYDVYASAIKQKLRQGVKQSPKERREPELFEERINRLYKSAKSFSIADLNSHTDANHTIESYFKQLGAYDREGEQRINLFTQIEMAQIEATDILAGKHGNISQSDKEIAILKGLLDAYKSLQHFVKPLLGHGDEADKDNEFDAKLREAWNALDIVTPLYNKVRNWLTRKPYSVEKIKLNFERAQLLGGWDVNKEPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDMADTTVHRASQPLVNKNALNKKRHSTFDYDIVKDRRYTVDKFLFHVPMTMNFKAVGRDNINSEVLNIIRNGGIKHIIGIDRGERHLLYLSLIDLRGNIVKQMTLNDIVNEYRGNTYSTNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKARDFFSKFDSIRYNDAKNWFEFAFDYNEFTEKAKDTRTRWTLCTWGTRIRTFRNPAKLNQWDNEEVVLTDVFKKAFDEAGIDIHSNLKEAICILTEKKHLESLMHLMKLLLQMRNSITNSEIDYLLSPVADENGHFYDSRTCDDTLPKDADANGAYNIARKGLWAIRTIQESSETERPNLALKNQDWLRFAQQKPYLND

SEQ ID NO: 1076 - protein, 1237 aa, synthetic construct
MHTMKKINELTALYPLSKTLRFELKPIGKTLDHIEQKGLIVQDEQRAEEYKQVKKIIDSYHKEFITMCLKGLKLNMVYLERYESLAREVHRDEAEFDKVKAALRKQIVEAFKQGGSYNDLFKKELIQKHLPEFVESEEEKKMVANFSKFTTYFTGFYRNRKNMYSDEEKSTAIAYRLIHENLPLFLDNMRSFRKIAESEVGGHFAKIEVRFEEYLNVEHLAEMFELDYFSDTLTQEQIAVYNSVIGGRTLDDGTKIQGINEYVNLYNQQHKEARLPLLKPLYKMILSDRVALSWLPENPFESDGEMVEAIKEMCQSLKEVLMGNDGLRNLLLNIDLYDIEHIYIANDLGLTDISQQMFGQYDVYASAIKQKLRQGVKQSPKERREPELFEERINRLYKSAKSFSIADLNSHTDANHTIESYFKQLGAYDREGEQRINLFTQIEMAQIEATDILAGKHGNISQSDKEIAILKGLLDAYKSLQHFVKPLLGHGDEADKDNEFDAKLREAWNALDIVTPLYNKVRNWLTRKPYSVEKIKLNFERAQLLGGWDVNREPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDMADTTVHRASQPLVNKNALNKKRHSTFDYDIVKDRRYTVDKFLFHVPMTMNFKAVGRDNINSEVLNIIRNGGIKHIIGIDRGERHLLYLSLIDLRGNIVKQMTLNDIVNEYRGNTYSTNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKARDFFSKFDSIRYNDAKNWFEFAFDYNEFTEKAKDTRTRWTLCTWGTRIRTFRNPAKLNQWDNEEVVLTDVFKKAFDEAGIDIHSNLKEAICILTEKKHLESLMHLMKLLLQMRNSITNSEIDYLLSPVADENGHFYDSRTCDDTLPKDADANGAYNIARKGLWAIRTIQESSETERPNLALKNQDWLRFAQQKPYLND

SEQ ID NO: 1077 - protein, 1237 aa, synthetic construct
MHTMKKINELTALYPLSKTLRFELKPIGKTLDHIEQKGLIVQDEQRAEEYKQVKKIIDSYHKEFITMCLKGLKLNMVYLERYESLAREVHRDEAEFDKVKAALRKQIVEAFKQGGSYNDLFKKELIQKHLPEFVESEEEKKMVANFSKFTTYFTGFYRNRKNMYSDEEKSTAIAYRLIHENLPLFLDNMRSFRKIAESEVGGHFAKIEVRFEEYLNVEHLAEMFELDYFSDTLTQEQIAVYNSVIGGRTLDDGTKIQGINEYVNLYNQQHKEARLPLLKPLYKMILSDRVALSWLPENPFESDGEMVEAIKEMCQSLKEVLMGNDGLRNLLLNIDLYDIEHIYIANDLGLTDISQQMFGQYDVYASAIKQKLRQGVKQSPKERREPELFEERINRLYKSAKSFSIADLNSHTDANHTIESYFKQLGAYDREGEQRINLFTQIEMAQIEATDILAGKHGNISQSDKEIAILKGLLDAYKSLQHFVKPLLGHGDEADKDNEFDAKLREAWNALDIVTPLYNKVRNWLTRKPYSVEKIKLNFERAQLLRGWDVNREPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDMADTTVHRASQPLVNKNALNKKRHSTFDYDIVKDRRYTVDKFLFHVPMTMNFKAVGRDNINSEVLNIIRNGGIKHIIGIDRGERHLLYLSLIDLRGNIVKQMTLNDIVNEYRGNTYSTNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKARDFFSKFDSIRYNDAKNWFEFAFDYNEFTEKAKDTRTRWTLCTWGTRIRTFRNPAKLNQWDNEEVVLTDVFKKAFDEAGIDIHSNLKEAICILTEKKHLESLMHLMKLLLQMRNSITNSEIDYLLSPVADENGHFYDSRTCDDTLPKDADANGAYNIARKGLWAIRTIQESSETERPNLALKNQDWLRFAQQKPYLND

SEQ ID NO: 1078 - protein, 1237 aa, synthetic construct
MHTMKKINELTALYPLSKTLRFELKPIGKTLDHIEQKGLIVQDEQRAEEYKQVKKIIDSYHKEFITMCLKGLKLNMVYLERYESLAREVHRDEAEFDKVKAALRKQIVEAFKQGGSYNDLFKKELIQKHLPEFVESEEEKKMVANFSKFTTYFTGFYRNRKNMYSDEEKSTAIAYRLIHENLPLFLDNMRSFRKIAESEVGGHFAKIEVRFEEYLNVEHLAEMFELDYFSDTLTQEQIAVYNSVIGGRTLDDGTKIQGINEYVALYNQQHKEARLPLLKPLYKMILSDRVALSWLPENPFESDGEMVEAIKEMCQSLKEVLMGNDGLRNLLLNIDLYDIEHIYIANDLGLTDISQQMFGQYDVYASAIKQKLRQGVKQSPKERREPELFEERINRLYKSAKSFSIADLNSHTDANHTIESYFKQLGAYDREGEQRINLFTQIEMAQIEATDILAGKHGNISQSDKEIAILKGLLDAYKSLQHFVKPLLGHGDEADKDNEFDAKLREAWNALDIVTPLYNKVRNWLTRKPYSVEKIKLNFENAQLLRGWDVNREPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDMADTTVHRASQPLVNKNALNKKRHSTFDYDIVKDRRYTVDKFQFHVPMTMNFKAVGRDNINSEVLNIIRNGGIKHIIGIDRGERHLLYLSLIDLRGNIVKQMTLNDIVNEYRGNTYSTNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKARDFFSKFDSIRYNDAKNWFEFAFDYNEFTEKAKDTRTRWTLCTWGTRIRTFRNPAKLNQWDNEEVVLTDVFKKAFDEAGIDIHSNLKEAICILTEKKHLESLMHLMKLLLQMRNSITNSEIDYLLSPVADENGHFYDSRTCDDTLPKDADANGAYNIARKGLWAIRTIQESSETERPNLALKNQDWLRFAQQKPYLND

SEQ ID NO: 1079 - protein, 1227 aa, synthetic construct
MKEQFINCYPLSKTLQFSLIPVGKTEDNFNKNLLLEKDKQRAENYEKVKGYIDRFHKEYIESVLSKARIEKVNEYADLYWKSNKDDSDTKAMESLENDMRKQISKQLKSGARYKRLFGKELICEDLPAFLTDENEKETVECFRSFTTYFKGFNRNRENMYSSDEKSTAIAYRCINDNLPRFLDNIKSFQKVFDNLSDKTITKLNTDLYNIFGRNIEDIFSVDYFEFVLTQSGIEIYNSMIGGYTCSDKTKIQGLNEYINLYNQQVAKNKKSKRLPLMKPLYKQILSEKDSVSFIPEKFNSDNEVLHAIGDYYNNHIGDFDLLTELLQSLNTYNANGIFVKSGVAITDISNGAFNSWNVLRSAWNEKYEALHPVTSKTKIDKYIEKQDKIYKAIKSFSLFELQSLGNENGNEITDWYISSINECNSKIKEAYLQAQELLNSDYEKSYDKRLSKNEKATELVKNLLDAIKEFQQLVKPLNGNGKEENKDELFYGKFASLYDSIADIDRLYDKVRNYITQKPYSKNKIKLNFDNPQLLRGWDKNRESDYRTVLLRKDDLYYLAVMGKSHSKAFANAPEITSYDEDFYEKMEYKLLPGPNKMLPKVFFATKNIDTFQPSDRILNIRKRESFKKGATFNKSECHQFIDYFKESIEKHDDWSQFGFKFTPTESYNDISEFYREISDQGYSVSFNKLSKSYVDELVENGYIYLFQIYNKDFSKYSKGTPNLHTLYFKMLFDDRNLSNVVYKLNGEAEMFYREATIGDKEKITHYANQPIKNKNPDNEKKESTFEYDIIKDNRFTKRQFSLHLPITINFKAHGQEILNYDVRKAVKYKNDNYVIGIDRGERNLIYISVINSNGKIVEQMSLNEIISDNGHKVDYQKLLDTKEKERDKARKNWTSVENIKELKEGYISQVVHKICELVVKYDAVIAMEDLNFGFKRGRFPVEKQVYQKFENMLISKLNLLIDKKADPTEDGGLLRAYQLTNKFDGVNKAKQNGIIFYVPAWDTSKIDPATGFVNLLKPKYTSVPEAKKLFETIDDIKYNANTDMFEFCIDYGKFPRCNSDFKKSWTVCTNSSRILTFRNKEKNNMWDNKQIVLTDEFKSLFNEFGINYKGNLKDSILSISNADFCKRLIKLLSLTLQMRNSITGSTLPEDDYLISPVANENGEFYDSRNYKGTTSALPCDADANGAYNIARKALWAINVLKDTPDDMLNKAKLSITNAEWLEYTQR

SEQ ID NO: 1080 - protein, 1227 aa, unidentified
MKEQFINCYPLSKTLRFSLIPVGKTEDNFNKKLLLESDKQRAENYENVKSYIDRFHKEYIKSALANARIEKINEYAALYWKNNKDDSDAKAMESLEDDIRKQISKQLTSTANFKRLFGKELICEDLPAFLTDENEKETVECFRSFTTYFNGFNRNRKNMYSSEKKSTAIAYRCVNDNLPRFLDNIKTFQKIFDNLSDETITKLNTDLYNIFGRKIEDIFSVDYFDFVLTQSGIDIYNYMIGGYTCSDGTKIQGLNECINLYNQQVAKNEKSKRLPLMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLESDYEKDYDKRLYKNEKATELVKNLLDAIKEFQQLVKLLNGTGKEENKDELFYGKFTSLYDSVADIDRLYDKVRNYITQRPYSKDKIKLNFDNPQLLRGWDKNRESDYRTVILRKNDFYYLAVMDKSHSKVFVNAPEITSEDEDYYEKMEYKLLPGPNKMLPKVFFASRNIDKFQPSDRILDIRKRESFKKGATFNKSECHEFIDYFKESIKKHDDWSKFGFEFSPTESYNDISEFYREVSDQGYYISFSKISKNYIDKLVENGYLYLFKIYNKDFSKYSKGTPNLHTLYFKMLFDERNLSNVVYKLNGEAEMFYREASINDKEKITHHANQPIKNKNPDNEKKESVFEYDIVKDKRFTKRQFSLHVSVTINFKAHGQEFLNYDVRKAVKYKDDNYVIGIDRGERNLIYISVINSNGEIVEQMSLNEIIGDNGYSVDYQKLLDKKEKERDKARKNWTSVENIKELKEGYISQVVHKICELVVKYDAVIAMEDLNFGFKRGRFPVEKQVYQKFENMLISKLNLLIDKKAEPTENGGLLRAYQLTNKFDGVNKAKQNGIIFYVPAWDTSKIDPVTGFVNLLKPKYTSVSEAKKLFETIDDIKYNTNTDMFEFCIDYGKFPRCNSDFKKTWTVCTNSSRILSFRNEKKNNEWDNKQIVLTDEFKSLFNEFGIDYTSDLKTSILSISNADFYNRLIRLLSLTLQMRNSIIGSTLPEDDYLISPVANDRGEFYDSRNYKGSNAALPCDADANGAYNIARKALWAINVLKDTPDDMLQKAKLSITNAEWLEYTQR

SEQ ID NO: 1081 - protein, 1200 aa, unidentified
MKEQFINCYPLSKTLQFSLIPVGKTDDNFNKKLLLERDKQRAENYEKVKGYIDRFHKEYIESVLVNARVEKIDEYADLYWKSNKDDSDAKAMESLENDMRKQISKQLKSNARYKRLFGKELICEDLPSFLTDKDERETVECFRSFTTYFKGFNRNRENMYSSDEKSTAIAYRCINDNLPRFLDNVKSFQKVFDNLSDETITKLNTDLYNTFGRNIEDIFSVDYFEFVLAQSGIDIYNSMIGGYTCSDGTKIQGLNECINLYNKQDAKNEKSKRLPLMKQLYKQILSEKGSVSFIPEKFNSDNEVLLSIEDYYSSHIGDFDLLTELLQSLNTYNANGIFVKSGAAVSDISNGAFNSWNVLRLAWNEKYEALHPVTSKTKLDNYIEKRDKIYKAIKSFSLFELQNLGNENGNEITDWYISSSKECNSKIKEAYLQARELLKSDYEKSYNKRLSKNGKATELVKNLLDAIKDFQHLVKSLNGTGKEENKDELFYGKLTSYYDSVADIDRLYDKVRNYITQKPYSKDKIKLNFDNPQLLRGWDKNRESDYRTVLLRKDDFYYLAVMDKSHSKAFVDAPNITSEDEDYYEKMEYKLLPGPNKMLPKVFFAAKNIDTFQPSDRILDIRKRESFKKGATFNKSECHEFIDYFKNSIEKHDDWSQFGFEFTPTENYNDISEFYREISDQGYSVSFNKISKSYVDELVDNGYIYLFQIYNKDFSKYSKGTPNLHTLYFKMLFDERNLSNVVYKLNGEAEMFYREASINDKEKITHQANQPIKNKNPDNEKKESTFEYDIIKDKRFTKRQFSLHVPITINFKAHGQEFLNYDVRKAVKYKDDNYVIGIDRGERNLIYISVIDSNGKIVEQMSLNEIISDNGHRVDYQKLLDTKEKERDKARKNWTSVENIKELKEGYISQVVHKICELVVKYDAVIAMEDLNFGFKRGRFPVEKQVYQKFENMLISKLNLLIDKKADPTEDGGLLRAYQLTNKFDGVNKGKQNGIIFYVPAWDTSKIDPVTGFVNLLKPKYTSVSEAKKLFETIDDIKYNANTDMFEFCIDYGKFPRCNSDYKKTWTVCTNSSRILTCRNKEKNDMWDNKQIVLTDEFKSLFGEFGIDYKGNLKTSILSISNADFYRRLIKLLSLTLQMRNSITGSTLPEDDYLISPVANDRGEFYGRGPAVIIKERMLHYLAMPMQTAHIILRERRFGQ

SEQ ID NO: 1082 - protein, 1158 aa, synthetic construct
MSKFQNLYTINKTLRFGLKPFGKTLENFNKTNLLQLDEYKAKHRKEVQRLFDENFKQLIEERLRGLSLDTQALEEAFDINKRDAALISLKKQVTGICYDSEMKKTYLQADKHFQKLLAAGPNQAMVCTYDKFSTYFVNFFRIRTHIFKGDTSGSIAYRLIDENLTIFKKNVDKIAKLPVGLKDEVEELADIESLQSYNSYLTQSGITEYNELLGGIAYEDGTKLQGINEKIALYGQKNKLKLPRLESLYKMILSDRETQSFVLSIIENDAELIGQISTLLEDVLLSKTLALSDVDGVFIKYTQLGNLPGVPYTVINSKINEAFDATYTGKKEGEKYKVTKKKTIEKDVYSLSKIEKLFQDSDINVSEALKNKYGVLIASYEEAKGLFNSIDWTEIKNIKQSGHTIIIKDVLDALKNIQFFYNLFDVVEENLNPSIEFYNELSLNKNQLGNEFNSTYNKARNYLTKKEYSEEKFKLNFDSPTLADGWDVNRETANLTILLRRFNSERNNYDYFLGVWKKAVPSREKNLIINADGEFEKMDYKLYPDPSKMLPKQFVSAQSWFDKYPASPEFMGKYEAGLHKKGNNFDIEFLHELINRYKHGLKHHENKYEETFDFELKETEEYSEYSEFIQDVSKSNYKVKFNHVAGVEELVEEGKLYLFQIWSKDFSTFSKGTKNLNTIYFESLFSEENLEKRIFKLSGGAELFYRPKSLTYTKELMEKGHHYNELKDSFNYPIIKDKRYTEDKFMFHVPIQINYGAENLGPVKLNNRINENIDGFTHIIGIDRGERHLVYISVVDVKTGKIVEQKHLDEIVNIDSKGKKHCTPYLQKLDERSKTRDQERKSWEAIETIKELKDGYISQVVNEICTLQQKYNALIVMENLNLGFKRSRFKVEKQIYQKFETALIKKFNYIIDKKDNSTYLHGLQLANPIQTLNSIGKQSGIIFYIPAWNTSKIDPTTGFVNLLYGADLRYTNKEQAEAFINKLDKIYFEDGVFKFDIDFKKWNQRYAKSCTKWTLTSYGTRVETKRDVIKNNMWCSNEIDLTAEFEKILNKRDGSLKTCDVETYKRFLYLFKLLLQIRNSITGTDTDYMISPVIAADGQQFDSRVVGMSLPNGLPKDADANGAYNIARKGLMAVHNIKAGFKKPFEISNEEYLEYLQK

SEQ ID NO: 1083 - protein, 1316 aa, synthetic construct
MHTMKKINELTALYPLSKTLRFELKPIGKTLDHIEQKGLIVQDEQRAEEYKQVKKIIDSYHKEFITMCLKGLKLNMVYLERYESLAREVHRDEAEFDKVKAALRKQIVEAFKQGGSYNDLFKKELIQKHLPEFVESEEEKKMVANFSKFTTYFTGFYRNRKNMYSDEEKSTAIAYRLIHENLPLFLDNMRSFRKIAESEVGGHFAKIEVRFEEYLNVEHLAEMFELDYFSDTLTQEQIAVYNSVIGGRTLDDGTKIQGINEYVNLYNQQHKEARLPLLKPLYKMILSDRVALSWLPENPFESDGEMVEAIKEMCQSLKEVLMGNDGLRNLLLNIDLYDIEHIYIANDLGLTDISQQMFGQYDVYASAIKQKLRQGVKQSPKERREPELFEERINRLYKSAKSFSIADLNSHTDANHTIESYFKQLGAYDREGEQRINLFTQIEMAQIEATDILAGKHGNISQSDKEIAILKGLLDAYKSLQHFVKPLLGHGDEADKDNEFDAKLREAWNALDIVTPLYNKVRNWLTRKPYSVEKIKLNFENAQLLGGWDVNREPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDMADTTVHRASQPLVNKNALNKKRHSTFDYDIVKDRRYTVDKFQFHVPMTMNFKAVGRDNINSEVLNIIRNGGIKHIIGIDRGERHLLYLSLIDLRGNIVKQMTLNDIVNEYRGNTYSTNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKARDFFSKFDSIRYNDAKNWFEFAFDYNEFTEKAKDTRTRWTLCTWGTRIRTFRNPAKLNQWDNEEVVLTDVFKKAFDEAGIDIHSNLKEAICILTEKKHLESLMHLMKLLLQMRNSITNSEIDYLLSPVADENGHFYDSRTCDDTLPKDADANGAYNIARKGLWAIRTIQESSETERPNLALKNQDWLRFAQQKPYLNDGRSSDDEATADSQHAAPPKKKRKVGGSGGSGGSGGSGGSGGSGGSGGSLEGSYPYDVPDYAYPYDVPDYAYPYDVPDYA

SEQ ID NO: 1084 - protein, 1158 aa, synthetic construct
MSKFQNLYTINKTLRFGLKPFGKTLENFNKTNLLQLDEYKAKHRKEVQRLFDENFKQLIEERLRGLSLDTQALEEAFDINKRDAALISLKKQVTGICYDSEMKKTYLQADKHFQKLLAAGPNQAMVCTYDKFSTYFVNFFDIRTHIFKGDTSGSIAYRLIDENLTIFKKNVDKIAKLPVGLKDEVEELADIESLQSYNSYLTQSGITEYNELLGGIAYEDGTKLQGINEKIALYGQKNKLKLPRLESLYKMILSDRETQSFVLSIIENDAELIGQISTLLEDVLLSKTLALSDVDGVFIKYTQLGNLPGVPYTVINSKINEAFDATYTGKKEGEKYKVTKKKTIEKDVYSLSKIEKLFQDSDINVSEALKNKYGVLIASYEEAKGLFNSIDWTEIKNIKQSGHTIIIKDVLDALKNIQFFYNLFDVVEENLNPSIEFYNELSLNKNQLGNEFNSTYNKARNYLTKKEYSEEKFKLNFDSPTLARGWDVNRETANLTILLRRFNSERNNYDYFLGVWKKAVPSREKNLIINADGEFEKMDYKLYPDPSKMLPKQFVSAQSWFDKYPASPEFMGKYEAGLHKKGNNFDIEFLHELINRYKHGLKHHENKYEETFDFELKETEEYSEYSEFIQDVSKSNYKVKFNHVAGVEELVEEGKLYLFQIWSKDFSTFSKGTKNLNTIYFESLFSEENLEKRIFKLSGGAELFYRPKSLTYTKELMEKGHHYNELKDSFNYPIIKDKRYTEDKFMFHVPIQINYGAENLGPVKLNNRINENIDGFTHIIGIDRGERHLVYISVVDVKTGKIVEQKHLDEIVNIDSKGKKHCTPYLQKLDERSKTRDQERKSWEAIETIKELKDGYISQVVNEICTLQQKYNALIVMENLNLGFKRSRFKVEKQIYQKFETALIKKFNYIIDKKDNSTYLHGLQLANPIQTLNSIGKQSGIIFYIPAWNTSKIDPTTGFVNLLYGADLRYTNKEQAEAFINKLDKIYFEDGVFKFDIDFKKWNQRYAKSCTKWTLTSYGTRVETKRDVIKNNMWCSNEIDLTAEFEKILNKRDGSLKTCDVETYKRFLYLFKLLLQIRNSITGTDTDYMISPVIAADGQQFDSRVVGMSLPNGLPKDADANGAYNIARKGLMAVHNIKAGFKKPFEISNEEYLEYLQK

SEQ ID NO: 1085 - protein, 1158 aa, synthetic construct
MSKFQNLYTINKTLRFGLKPFGKTLENFNKTNLLQLDEYKAKHRKEVQRLFDENFKQLIEERLRGLSLDTQALEEAFDINKRDAALISLKKQVTGICYDSEMKKTYLQADKHFQKLLAAGPNQAMVCTYDKFSTYFVNFFRIRTHIFKGDTSGSIAYRLIDENLTIFKKNVDKIAKLPVGLKDEVEELADIESLQSYNSYLTQSGITEYNELLGGIAYEDGTKLQGINEKIALYGQKNKLKLPRLESLYKMILSDRETQSFVLSIIENDAELIGQISTLLEDVLLSKTLALSDVDGVFIKYTQLGNLPGVPYTVINSKINEAFDATYTGKKEGEKYKVTKKKTIEKDVYSLSKIEKLFQDSDINVSEALKNKYGVLIASYEEAKGLFNSIDWTEIKNIKQSGHTIIIKDVLDALKNIQFFYNLFDVVEENLNPSIEFYNELSLNKNQLGNEFNSTYNKARNYLTKKEYSEEKFKLNFDSPTLARGWDVNKETANLTILLRRFNSERNNYDYFLGVWKKAVPSREKNLIINADGEFEKMDYKLYPDPSKMLPKQFVSAQSWFDKYPASPEFMGKYEAGLHKKGNNFDIEFLHELINRYKHGLKHHENKYEETFDFELKETEEYSEYSEFIQDVSKSNYKVKFNHVAGVEELVEEGKLYLFQIWSKDFSTFSKGTKNLNTIYFESLFSEENLEKRIFKLSGGAELFYRPKSLTYTKELMEKGHHYNELKDSFNYPIIKDKRYTEDKFMFHVPIQINYGAENLGPVKLNNRINENIDGFTHIIGIDRGERHLVYISVVDVKTGKIVEQKHLDEIVNIDSKGKKHCTPYLQKLDERSKTRDQERKSWEAIETIKELKDGYISQVVNEICTLQQKYNALIVMENLNLGFKRSRFKVEKQIYQKFETALIKKFNYIIDKKDNSTYLHGLQLANPIQTLNSIGKQSGIIFYIPAWNTSKIDPTTGFVNLLYGADLRYTNKEQAEAFINKLDKIYFEDGVFKFDIDFKKWNQRYAKSCTKWTLTSYGTRVETKRDVIKNNMWCSNEIDLTAEFEKILNKRDGSLKTCDVETYKRFLYLFKLLLQIRNSITGTDTDYMISPVIAADGQQFDSRVVGMSLPNGLPKDADANGAYNIARKGLMAVHNIKAGFKKPFEISNEEYLEYLQK

SEQ ID NO: 1086 - protein, 1307 aa, synthetic construct
MKAKYMNYQLLFQKFVHLYPISKTLRFELIPQGATQKFITEKQVLLQDEVRARKYPEMKQAIDGYHKDFIQRALGNIDSQSFEQALQTFQELFLRSQAERSTEAYKKEFETTQTKLRELIVNSFEKGEFKQEYKSLFDKNLITNLLKPWVEKQSQTGDNNYTYHNDFNKFTTYFLGFHRNRKNIYSKEPHKTALAYRLIHENLPKFLENNKILRKIQNDHPALWEQLQALHHTMPQLFNGWDLSQLLQVSFFSNTLTQTGIDQYNTIIGGISEGENRQKIQGINELIALYNQKQDKKNRVAKLKQLYKQILSDRSTLSFLPQQFADDAELYHAINMFYLDHLHYQSMVNGHSYTLLERVQLLINELANYDLSKVYLAPNQLSAVSHQMFGDFGYISRALSYYYMQVIQPDYELLLASAKTTAKIEAIEKLKTAFLDAPHSLVVIQAAIDKYLQLQPSSKPHTQLTDFIISLLKQYETVADDQSIKIINIFSDIEGKYSCIKGLVNTESTSESKREILQNEKLATDIKAFMDAINNVIKLLKPFALNEKLAASVEKDARFYSDFEEIYQALLVFVPLYNKVRNYITQKPYSTEKFKLNFNKPTLLSGWDANREADNLSILLRKNGNYYLAIMDTAKGANKAFEPKALNQLKVDDTTDCYEKMVYKLLPGPNKMFPKVFFSESRKAQFNPPQHIIESYNKKEHISSEAHFDLKKCHALIDWFKQCIELHEDWKHFNFKFSPTSQYSNISDFYKEVSEQNYKVHFQDIPADYIEQLVAEGKLYLFQIYNKDFSPHAKGKENLHTMYFKALFSEENLKQPVFKLSGEAEMFYRPASLQLENTTIHKAGEAMVAKNPLTPDATRTLAYDIIKDRRFTTDKYLLHIPISLNFHAQESMSIKKHNDLVRQMIKHNHQDLHIIGIDRGEKHLLYVSVIDLKGNIVYQESLNSIKSEAQNFETPYHQLLQHREEGRAQARTAWGKIENIKELKDGYLSQVVHRIQQLILKYNAIVMLEDLNFGFKRGRFKIEKQIYQKFEKALIHKLNYVVDKSTQADELGGVRKAYQLTAPFESFEKLGKQSGVLFYVPAWNTSKIDPVTGFVDLLKPKYENLDKAQAFFKTFDSIIFNAKKDYFEFKVNLNQFAGLKAQAARAEWTICSYGPERHVYQKKNAQQGETVIVNVTEELKALFAKNNIEVAEGVELKEMICAQTQVDFFKRLIWLLQVLLALRYSSSKDKLDYILSPVANVLGEFFDSRHASTHLPQDSDANGAYHIALKGLWVIEQLKTAANTEKVNLAISNDEWLRFAQEKLYLT

SEQ ID NO: 1087 - protein, 1229 aa, synthetic construct
MKEQFINRYPLSKTLRFSLIPVGETENNFNKNLLLEKDKQRAENYEKVKGYIDRFHKEYIESVLSKARIEKVDEYANLYWKSNKDDSDIKAMESLENDMRKQISKQFTSIEIYKRLFEKELICEDLPAFLTDKDERETVECFRSFTTYFKGFNRNRKNMYSSDEKSTAIAYRCINDNLPRFLDNVKSFQKVLNNLSDETVTKLNTDLYNIFGRNIEDIFSVDYFEFVLAQSGIEIYNSMIGGYTCSDGTKIQGLNECIALYNQQVAKNEKSKRLPLMKPLYKQILSEKDSVSFIPEKFNSDNEVLLAIEDYYNSHIGVIDLLTELLQSLNTYNANGIFVKSGVAITDISNGAFNSWNVLRSAWNEKYEALHPITSKTKIDKYIEKRDKIYKAIKSFSLFELQSLGNENGNEITDWYISSINECNSKIKEAYLQAQESLKSDYEKNYNKRLYKNEKSTELVKNLLDAIKEFQHFVKPLNGTSKEENKDELFYGKFTSHYDSIADIDRLYDKVRNYITQKPYSKDKIKLNFDNPQLLGGWDKNRESDYRTVLLHKDGLYYLAVMDKSHSKAFVDAPEIASDDEDYYEKMEYKLLPGPNKMLPKVFFASKNIDTFQPSDRILDIRKRESFKKGATFNKSECHEFIDYFKGSIEKHDDWSQFGFKFSPTESYNDISEFYREISDQGYSVSFNKISKSYVDELVDNGYIYLFQIYNKDFSKYSKGTPNLHTLYFKMLFDERNLSNVVYKLNGEAEMFYREASINDKEKITHQANQPIENKNPDNKKKESTFEYDIVKDKRFTKRQFSLHVPITINFKAHGQEFLNNDVRKAVKYKDDNYVIGIDRGERNLIYISVINSNGKIVEQMSLNEIISDNGHKVDYQKLLDTKEKERDKARKNWTSVENIKELKEGYISQVVHKICELVVKYDAVIAMEDLNFGFKRGRFPVEKQVYQKFENMLISKLNLLIDKKADPTENGGLLRAYQLTNKFDGVNKAKQNGIIFYVPAWDTSKIDPATGFVNLLKPKYTSVPEAKNLFETIDDIKYNANTDMFEFYIDYSKFPRCNSDFKKSWTVCTNSSRILTFPNKEKNNMWDNKQIVLTDEFKSLFNEFGIDYKGNLKDSILSISNADFYGRLIKLFSLTLQMRNSITGSTLPEDDYLISPVANESGEFYDSRNYKGTNAALPCDADANGAYNIARKALWAINVLKDTPDDMLNKAKLSITNAEWLEYTQRTS

SEQ ID NO: 1088 - protein, 1228 aa, synthetic construct
MKEQFINRYPLSKTLRFALIPVGETENNFNKNLLLERDKQRAENYEKVKGYIDRFHKEYIESVLSKARIEKVDEYANLYWKSNKDDSDAKAMESLENDMRKQISKQLTSTEIFKKRLFGKELICEDLPAFLTDENEKETVECFKNFTTYFNGFHRNRKNMYSSDGKSTAIAYRCINDNLPRFLDNVKSFQKVFDNLSDETITKLNTDLYNIFGRNIEDIFSVGYFEFVLAQSGIEIYNSMIGGYTCSDKTKIQGLNEYIALYNQQVAKNEKSKRLPLMKPLYKQILSEKDSVSFIPEKFHSDNEVLHAIGDYYNNHIGDFDLLTELLQSLNTYNANGIFVKSGVAITDISNGAFNSWNVLRSAWNEKYEALHPVTSKTKIDKYIEKRDKIYKAIKSFSLFELQSLGNENGNEITDWYVSSINECNSKIKEAYLQAQELLNSDYETSYNKRLYKNEEATELVKNLLDAIKDFQKLIKPLNGTGKEENKDELFYGKFTSHYDSIADIDRLYDKVRNYITQKPYSKDKIKLNFDNPQLLGGWDKNRESDYRTVLLHKDGFYYLAVMGKSHSKVFVDAPEITSYDEDYYEKMEYKLLPGPNKMLPKVFFATKNIDTFQPSDRILDIRKRESFKKGATFNKAECHEFIDYFKESIEKHDDWSQFGFEFSPTESYNDISEFYREISDQGYSVRFNKISKNYIDGLVENGYIYLFKIYNKDFSKYSKGTPNLHTLYFKMLFDDRNLSNVVYKLNGEAEMFYREASINDKEKITYQANQPIENKNPDNEKKESVFEYDIVKDKRFTKRQFSLHLPITINFKAHGQEFLNYDVRKAVKYKDDNYVIGIDRGERNLIYISVINSNGKIVEQMSLNEIISDNGHRVDYQKLLDKKEKERDKARKNWTSVENIKELKEGYISQVVHKICELVVKYDAVIAMEDLNFGFKRGRFPVEKQIYQKFENMLISKLNLLIDKKADPTENGGLLRAYQLTNKFDGVNKAKQNGIIFYVPAWDTSKIDPVTGFVNLLKPKYTSVQEAKNLFETIDDIKYNANTDMFEFYIDYSKFPRCNSDFKKTWTVCTNSSRILTFRNKDKNNMWDNKQIVLTDAFKSLFNEFGIDYKGNLKDSILSISNVDFYKRLIKLLSLTLQMRNSITGSTLPEDDYLISPVANESGEFYDSRNYKGTNAALPCDADANGAYNIARKALWAINVLKDTPDDMLNKAKLSITNAEWLAYTQR

SEQ ID NO: 1089 - protein, 1235 aa, synthetic construct
MKEQFINRYPLSKTLRFSLIPVRSEEHIPVGETENNFNKNLLLEKDKQRAENYEKVKGYIDRFHKEYIESVLSKARIEKVDEYANLYWKSNKDDPDIKAMESLESDMRKQISKQLKSNARYKRLFGKELICEDLPSFLTDKDERETVECFRSFTTYFKGFNRNRENMYSSDEKSTAIAYRCINDNLPRFLDNVKSFQKAFDNLSDETITKLNTDLYNIFGRNIEDIFSVDYFEFVLAQSGIEIYNSMIGGYTCSDGTKIQGLNEYIALYNQQVAKNEKSKRLPLMKPLYKQILSEKDSVSFIPEKFNSDNEVLLAIEDYYTGHIGDIDLLTELLQLLNIYNANGIFVKSGVAITDISNGAFNSWNVLRSAWNEKYEALHPVTSKTKIDKYIEKQDKVYKATKSFSLFELQSLGNENGNEITDWYISSINECNSKIKEAYLQAQELLKSDYEKSYDKRLYKNEKATELIKNLLDAIKDFQHLVKPLNGTGKEENKDELFYGKFTSYYDSVADIDKLYDRVRNYITKKPYSKDKIKLNFDNPQLLGGWDKNRESDYRTVLLHKDGLYYLAVMVKSHSKAFVDAPEITSDDEDYYEKMEYKLLPGPNKMLPKVFFATKNIDTFQPSDRILDIRKRESFKKGATFNKAECHEFIDYFKESIEKHDDWSQFGFEFSPTESYNDISEFYREISDQGYSVRFNKISKNYIDGLVENGYIYLFQIYNKDFSKYSKGTPNLHTLYFKMLFDERNLSNVVYKLNGEAEMFYREASIGDKEKITHYANQPIENKNPDNEKKESVFEYDIVKDKRFTKRQFSLHVPITINFKAHGQEFLNNDIRKAIKYKDDNYVIGIDRGERNLIYISVINSNGKIVEQMSLNKIISDNGYRVDYQKLLDAKEDKRDKARKNWTSVENIKELKEGYISQVVHKICELVVKYDAVIAMEDLNFGFKRGRFPVEKQVYQKFENMLISKLNLLIDKKAEPTENGGLLRAYQLTNKFDGVNKAKQNGIIFYVPAWDTSKIDPATGFVNLLKPKYTSVPEAKKLFETIDDIKYNATTDMFEFYIDYSKFPRCNSDFKKAWTVCTNSSRILTFRNKEKNNMWDNKQIVLTDEFKSLFNEFGIDYKGNLKDSILSISNVDFYKRLIKLLSLTLQMRNSITGSTLPEDDYLISPVANENGEFYDSRNYKGTNAALPCDADANGAYNIARKALWAINVLKDTPDEMLNNAKLSITNAEWLEYTQR

SEQ ID NO: 1090 - protein, 1216 aa, synthetic construct
MANIYENFTNMYQVNKTIRMGLKPICKTDENIAKFLEEDKERSEKYKIAKKIIDKENRAFIEDRLKDFSISGLDEYLELLKQKKDITKIQKKMRDEISKQLKGFPQFDSKYKFQYITDKEDTEILEYFKKFTTFFTGFNRNRENVYSKEDISTSIGHRIIHENLPKFISNFRILNKAIEALGTGKINEDFKNNEINVTVEELNKIDYFNKVLTQSGIDLYNNLIGILNQNIALYNQQQKVKKNKIGKLETLHKQILSEKDKVSFIEEFAEDNQLLKCIDEYFKEKSCLINVDLKNLLENIDTYSLNGIFIKNDKSLKNISIYLYKDWGYISNLINEEYDYKHKNKVKDDKYYEKRKKAIDKIKYFSIGYIDELLKDKNVPMVECYFKEKINLVVKEFIDYLNKFNEYKFTNELKTDEIAVEIIKNLCDSIKDVQEIVKPLIVIENDKDDSFYGEINYIWDELNKFNKIYNMVRNYLTKKDYIDEKIRLTFNNPQLLGGWSYKREADYSSFILKDNKYYYLAIMNPNSKSKLKDLKKPENDGDTIYKMKYFQASDPAKSIPNLMVINGKTEKKNGRKDNDGENRELERLRNEYLPTEINEIRKNKAYLRSSSNFSNEALVKYIDYYKERVKEYFNEIDFKFKETCEYKQFNEFAEDVNLQAYQISFIEVSKKYIKSLIDDNKIYLFKIYNKDFSKYSKGTPNLHTLYFKMLFDKENLENPIYKLSGNAEMFFRKGNLDLDKTTIHHANQPINNKNPNNRKKQSVFKYDIIKNRRYTVDKFALHMSITTNFQVYKNKNVNETVNRALKYCDDIYAIGIDRGERNLLYACVVNSRGEIVKQVPLNFVCNTDYHQLLAKREEERMNSRKNWKIIDNIKNLKEGYLSQAIHIITDFMVEYNAVLVLEDLNFRFKEKRMKFEKSVYQKFEKMLIDKLNFLVDKKLDKNANGGLFNAYQLTEKFTSFKDMKNQNGIVFYIPAWMTSKIDPVTGFTNLFYIKYESIEKSKEFFGKFKSIKFNKVDNYFEFEFDYNDFTDRAQGTRSKWTVCSFGPRIEGFRNPEKNNKWDGREIDITEKIKKLLDDYNISLDEDIQAQIMDINTKDFFEKLIKYFKLVLQMRNSKTGTDIDYIISPVRNKQNEFFDSRKKNEKLPMDADANGAYNIARKGLMFIDIIKETEDKDLKMPKLFIKNKDWLNYVQKSDLTSKRPAATKKAGQAKKKK

SEQ ID NO: 1091 - protein, 1228 aa, synthetic construct
MKEQFINRYPLSKTLRFALIPVGETENNFNKNLLLERDKQRAENYEKVKGYIDRFHKEYIESVLSKARIEKVDEYANLYWKSNKDDSDAKAMESLENDMRKQISKQLTSTEIFKKRLFGKELICEDLPAFLTDENEKETVECFKNFTTYFNGFHRNRKNMYSSDGKSTAIAYRCINDNLPRFLDNVKSFQKVFDNLSDETITKLNTDLYNIFGRNIEDIFSVGYFEFVLAQSGIEIYNSMIGGYTCSDKTKIQGLNEYINLYNQQVAKNEKSKRLPLMKPLYKQILSEKDSVSFIPEKFHSDNEVLHAIGDYYNNHIGDFDLLTELLQSLNTYNANGIFVKSGVAITDISNGAFNSWNVLRSAWNEKYEALHPVTSKTKIDKYIEKRDKIYKAIKSFSLFELQSLGNENGNEITDWYVSSINECNSKIKEAYLQAQELLNSDYETSYNKRLYKNEEATELVKNLLDAIKDFQKLIKPLNGTGKEENKDELFYGKFTSHYDSIADIDRLYDKVRNYITQKPYSKDKIKLNFDNPQLLGGWDKNKESDYRTVLLHKDGFYYLAVMGKSHSKVFVDAPEITSYDEDYYEKMEYKLLPGPNKMLPKVFFATKNIDTFQPSDRILDIRKRESFKKGATFNKAECHEFIDYFKESIEKHDDWSQFGFEFSPTESYNDISEFYREISDQGYSVRFNKISKNYIDGLVENGYIYLFKIYNKDFSKYSKGTPNLHTLYFKMLFDDRNLSNVVYKLNGEAEMFYREASINDKEKITYQANQPIENKNPDNEKKESVFEYDIVKDKRFTKRQFSLHLPITINFKAHGQEFLNYDVRKAVKYKDDNYVIGIDRGERNLIYISVINSNGKIVEQMSLNEIISDNGHRVDYQKLLDKKEKERDKARKNWTSVENIKELKEGYISQVVHKICELVVKYDAVIAMEDLNFGFKRGRFPVEKQIYQKFENMLISKLNLLIDKKADPTENGGLLRAYQLTNKFDGVNKAKQNGIIFYVPAWDTSKIDPVTGFVNLLKPKYTSVQEAKNLFETIDDIKYNANTDMFEFYIDYSKFPRCNSDFKKTWTVCTNSSRILTFRNKDKNNMWDNKQIVLTDAFKSLFNEFGIDYKGNLKDSILSISNVDFYKRLIKLLSLTLQMRNSITGSTLPEDDYLISPVANESGEFYDSRNYKGTNAALPCDADANGAYNIARKALWAINVLKDTPDDMLNKAKLSITNAEWLAYTQR

SEQ ID NO: 1092 - protein, 1205 aa, synthetic construct
MKLEDFTNLYSLSKTLRFELRPIGKTRENIENGGLLRQDEDRAEKYVHIKKLIDEYHKAYIDKQLSGLVLQYADIGKANSLEEYYHSTRKSKDSDKDKIVKIQDNLRKQIVKRLKDSDEFKRIDKKELIQSDLAEFIKPAEDRALIAEFKNFTTYFTGFNENRQNMYSDKAISTAIAYRLIHENLPKFIDNIETFDRIAGITELYDQTSSDAEIFRLAHFSETLSQKQIDAYNSVMGRYNMLINEYNQTHKQSRLPKFKMLYKQILSDREHPSWLPEQFESDTAVLTAIRECYDDLRIPMANLKTLLEGLGNYDPSGIFLRNDQHLSQISKRLTGDRSSIERSVTEDLLTSRKLNKRKSRTTDEEESRKLFKQKGSLSIGYIADTAKIDVERYFAKLGAINTVTEQSENLFAKAENARTTADELLANDYPAGKRLVQSNDDIALVKNLLDALMELQWFVKPLLGTGDEAGKDERFYGEFTQIWEQLDRITPLYNMVRNYVTRKPYSTDKFKLNFESAALLGGWDKNREPDCLSVILRKDEQYYLGIINKNHKKIFARDILPCEGECYEKMVYKQISISAGIGGFFRKCYRTAEQYGWCCSDSCLNDERKIIIRDDEARENLTEIINCQKDFLNKYEKDGFKYRDFGFRFAASSDYEKLSDFYRDIDEQRYKLSFTPVSATYIDSLVEEGKLYLFQIYNKDFSAYSKGTPNMHTLYWRMLFDERNLSDVVYQLNGGAELFFRRKSLQNGRPTHPANIPIKNKNSRNDKKESLFDYDLIKDRRYTVDKFQFHVPITLNFKSDGAGRINERVREYLRSADDVHVIGIDRGERNLLYLVVTDMDGNICEQFSLNEICNTDYHSLLDEREHKRMQERQSWQAIEGIKELKEGYLSQVVHRIATLMVKYRAIVVLEDLNFGFMRSRQKVEKSVYQKFEHMLIDKLNYLVDKKANPTTPGGLLKAYQLTDKFESFQKLGKQSGFLFYVPAWNTSKIDPATGFVNMLDLGYESIDKAKALLCKFDSIRYNACKDWFEFALDYDKFGSKATGTRTKWTVCTYGQRIDTYRNKDSQWVSRDVDLTNELKSLFSEHGIDIYSNLKDAIVAQNDKEFFANMLRILKLTMQMRNSKTGTDIDYIVSPVADANGRFFDSRQADATMPKDADANGAYNIARKGIMLVQQIKQSDDLRTMKFDISNKSWLRFVQHTNQADE

SEQ ID NO: 1093 - protein, 1227 aa, synthetic construct
MKEQFINRYPLSKTLRFSLIPVGETENNFNKNLLLEKDKQRAENYEKVKGYIDRFHKEYIESVLSKARIEKVDEYANLYWKSNKDDSDIKAMESLENDMRKQISKQFTSIEIYKRLFEKELICEDLPAFLTDKDERETVECFRSFTTYFKGFNRNRKNMYSSDEKSTAIAYRCINDNLPRFLDNVKSFQKVLNNLSDETVTKLNTDLYNIFGRNIEDIFSVDYFEFVLAQSGIEIYNSMIGGYTCSDGTKIQGLNECINLYNQQVAKNEKSKRLPLMKPLYKQILSEKDSVSFIPEKFNSDNEVLLAIEDYYNSHIGVIDLLTELLQSLNTYNANGIFVKSGVAITDISNGAFNSWNVLRSAWNEKYEALHPITSKTKIDKYIEKRDKIYKAIKSFSLFELQSLGNENGNEITDWYISSINECNSKIKEAYLQAQESLKSDYEKNYNKRLYKNEKSTELVKNLLDAIKEFQHFVKPLNGTSKEENKDELFYGKFTSHYDSIADIDRLYDKVRNYITQKPYSKDKIKLNFDNPQLLGGWDKNKESDYRTVLLHKDGLYYLAVMDKSHSKAFVDAPEIASDDEDYYEKMEYKLLPGPNKMLPKVFFASKNIDTFQPSDRILDIRKRESFKKGATFNKSECHEFIDYFKGSIEKHDDWSQFGFKFSPTESYNDISEFYREISDQGYSVSFNKISKSYVDELVDNGYIYLFQIYNKDFSKYSKGTPNLHTLYFKMLFDERNLSNVVYKLNGEAEMFYREASINDKEKITHQANQPIENKNPDNKKKESTFEYDIVKDKRFTKRQFSLHVPITINFKAHGQEFLNNDVRKAVKYKDDNYVIGIDRGERNLIYISVINSNGKIVEQMSLNEIISDNGHKVDYQKLLDTKEKERDKARKNWTSVENIKELKEGYISQVVHKICELVVKYDAVIAMEDLNFGFKRGRFPVEKQVYQKFENMLISKLNLLIDKKADPTENGGLLRAYQLTNKFDGVNKAKQNGIIFYVPAWDTSKIDPATGFVNLLKPKYTSVPEAKNLFETIDDIKYNANTDMFEFYIDYSKFPRCNSDFKKSWTVCTNSSRILTFPNKEKNNMWDNKQIVLTDEFKSLFNEFGIDYKGNLKDSILSISNADFYGRLIKLFSLTLQMRNSITGSTLPEDDYLISPVANESGEFYDSRNYKGTNAALPCDADANGAYNIARKALWAINVLKDTPDDMLNKAKLSITNAEWLEYTQR

SEQ ID NO: 1094 - protein, 1235 aa, synthetic construct
MKEQFINRYPLSKTLRFSLIPVRSEEHIPVGETENNFNKNLLLEKDKQRAENYEKVKGYIDRFHKEYIESVLSKARIEKVDEYANLYWKSNKDDPDIKAMESLESDMRKQISKQLKSNARYKRLFGKELICEDLPSFLTDKDERETVECFRSFTTYFKGFNRNRENMYSSDEKSTAIAYRCINDNLPRFLDNVKSFQKAFDNLSDETITKLNTDLYNIFGRNIEDIFSVDYFEFVLAQSGIEIYNSMIGGYTCSDGTKIQGLNEYINLYNQQVAKNEKSKRLPLMKPLYKQILSEKDSVSFIPEKFNSDNEVLLAIEDYYTGHIGDIDLLTELLQLLNIYNANGIFVKSGVAITDISNGAFNSWNVLRSAWNEKYEALHPVTSKTKIDKYIEKQDKVYKATKSFSLFELQSLGNENGNEITDWYISSINECNSKIKEAYLQAQELLKSDYEKSYDKRLYKNEKATELIKNLLDAIKDFQHLVKPLNGTGKEENKDELFYGKFTSYYDSVADIDKLYDRVRNYITKKPYSKDKIKLNFDNPQLLGGWDKNKESDYRTVLLHKDGLYYLAVMVKSHSKAFVDAPEITSDDEDYYEKMEYKLLPGPNKMLPKVFFATKNIDTFQPSDRILDIRKRESFKKGATFNKAECHEFIDYFKESIEKHDDWSQFGFEFSPTESYNDISEFYREISDQGYSVRFNKISKNYIDGLVENGYIYLFQIYNKDFSKYSKGTPNLHTLYFKMLFDERNLSNVVYKLNGEAEMFYREASIGDKEKITHYANQPIENKNPDNEKKESVFEYDIVKDKRFTKRQFSLHVPITINFKAHGQEFLNNDIRKAIKYKDDNYVIGIDRGERNLIYISVINSNGKIVEQMSLNKIISDNGYRVDYQKLLDAKEDKRDKARKNWTSVENIKELKEGYISQVVHKICELVVKYDAVIAMEDLNFGFKRGRFPVEKQVYQKFENMLISKLNLLIDKKAEPTENGGLLRAYQLTNKFDGVNKAKQNGIIFYVPAWDTSKIDPATGFVNLLKPKYTSVPEAKKLFETIDDIKYNATTDMFEFYIDYSKFPRCNSDFKKAWTVCTNSSRILTFRNKEKNNMWDNKQIVLTDEFKSLFNEFGIDYKGNLKDSILSISNVDFYKRLIKLLSLTLQMRNSITGSTLPEDDYLISPVANENGEFYDSRNYKGTNAALPCDADANGAYNIARKALWAINVLKDTPDEMLNNAKLSITNAEWLEYTQR

SEQ ID NO: 1095 - protein, 1200 aa, unidentified
MKEQFINCYPLSKTLQFSLIPVGKTDDNFNKKLLLERDKQRAENYEKVKGYIDRFHKEYIESVLVNARVEKIDEYADLYWKSNKDDSDAKAMESLENDMRKQISKQLKSNARYKRLFGKELICEDLPSFLTDKDERETVECFRSFTTYFKGFNTNRENMYSSDEKSTAIAYRCINDNLPRFLDNVKSFQKVFDNLSDETITKLNTDLYNTFGRNIEDIFSVDYFEFVLAQSGIDIYNSMIGGYTCSDGTKIQGLNECINLYNKQDAKNEKSKRLPLMKQLYKQILSEKGSVSFIPEKFNSDNEVLLSIEDYYSSHIGDFDLLTELLQSLNTYNANGIFVKSGAAVSDISNGAFNSWNVLRLAWNEKYEALHPVTSKTKLDNYIEKRDKIYKAIKSFSLFELQNLGNENGNEITDWYISSSKECNSKIKEAYLQARELLKSDYEKSYNKRLSKNGKATELVKNLLDAIKDFQHLVKSLNGTGKEENKDELFYGKLTSYYDSVADIDRLYDKVRNYITQKPYSKDKIKLNFDNPQLLGGWDKNKESDYRTVLLRKDDFYYLAVMDKSHSKAFVDAPNITSEDEDYYEKMEYKLLPGPNKMLPKVFFAAKNIDTFQPSDRILDIRKRESFKKGATFNKSECHEFIDYFKNSIEKHDDWSQFGFEFTPTENYNDISEFYREISDQGYSVSFNKISKSYVDELVDNGYIYLFQIYNKDFSKYSKGTPNLHTLYFKMLFDERNLSNVVYKLNGEAEMFYREASINDKEKITHQANQPIKNKNPDNEKKESTFEYDIIKDKRFTKRQFSLHVPITINFKAHGQEFLNYDVRKAVKYKDDNYVIGIDRGERNLIYISVIDSNGKIVEQMSLNEIISDNGHRVDYQKLLDTKEKERDKARKNWTSVENIKELKEGYISQVVHKICELVVKYDAVIAMEDLNFGFKRGRFPVEKQVYQKFENMLISKLNLLIDKKADPTEDGGLLRAYQLTNKFDGVNKGKQNGIIFYVPAWDTSKIDPVTGFVNLLKPKYTSVSEAKKLFETIDDIKYNANTDMFEFCIDYGKFPRCNSDYKKTWTVCTNSSRILTCRNKEKNDMWDNKQIVLTDEFKSLFGEFGIDYKGNLKTSILSISNADFYRRLIKLLSLTLQMRNSITGSTLPEDDYLISPVANDRGEFYGRGPAVIIKERMLHYLAMPMQTAHIILRERRFGQ

SEQ ID NO: 1096 - protein, 1158 aa, synthetic construct
MSKFQNLYTINKTLRFGLKPFGKTLENFNKTNLLQLDEYKAKHRKEVQRLFDENFKQLIEERLRGLSLDTQALEEAFDINKRDAALISLKKQVTGICYDSEMKKTYLQADKHFQKLLAAGPNQAMVCTYDKFSTYFVNFFRIRTHIFKGDTSGSIAYRLIDENLTIFKKNVDKIAKLPVGLKDEVEELADIESLQSYNSYLTQSGITEYNELLGGIAYEDGTKLQGINEKIALYGQKNKLKLPRLESLYKMILSDRETQSFVLSIIENDAELIGQISTLLEDVLLSKTLALSDVDGVFIKYTQLGNLPGVPYTVINSKINEAFDATYTGKKEGEKYKVTKKKTIEKDVYSLSKIEKLFQDSDINVSEALKNKYGVLIASYEEAKGLFNSIDWTEIKNIKQSGHTIIIKDVLDALKNIQFFYNLFDVVEENLNPSIEFYNELSLNKNQLGNEFNSTYNKARNYLTKKEYSEEKFKLNFDSPTLARGWDVNRETANLTILLRRFNSERNNYDYFLGVWKKAVPSREKNLIINADGEFEKMDYKLYPDPSKMLPKQFVSAQSWFDKYPASPEFMGKYEAGLHKKGNNFDIEFLHELINRYKHGLKHHENKYEETFDFELKETEEYSEYSEFIQDVSKSNYKVKFNHVAGVEELVEEGKLYLFQIWSKDFSTFSKGTKNLNTIYFESLFSEENLEKRIFKLSGGAELFYRPKSLTYTKELMEKGHHYNELKDSFNYPIIKDKRYTEDKFMFHVPIQINYGAENLGPVKLNNRINENIDGFTHIIGIDRGERHLVYISVVDVKTGKIVEQKHLDEIVNIDSKGKKHCTPYLQKLDERSKTRDQERKSWEAIETIKELKDGYISQVVNEICTLQQKYNALIVMENLNLGFKRSRFKVEKQIYQKFETALIKKFNYIIDKKDNSTYLHGLQLANPIQTLNSIGKQSGIIFYIPAWNTSKIDPTTGFVNLLYGADLRYTNKEQAEAFINKLDKIYFEDGVFKFDIDFKKWNQRYAKSCTKWTLTSYGTRVETKRDVIKNNMWCSNEIDLTAEFEKILNKRDGSLKTCDVETYKRFLYLFKLLLQIRNSITGTDTDYMISPVIAADGQQFDSRVVGMSLPNGLPKDADANGAYNIARKGLMAVHNIKAGFKKPFEISNEEYLEYLQK

SEQ ID NO: 1097 - protein, 9 aa, synthetic construct
PAAKRVKLD

SEQ ID NO: 1098 - protein, 16 aa, synthetic construct
KRPAATKKAGQAKKKK

SEQ ID NO: 1099 - protein, 24 aa, synthetic construct
GRSSDDEATADSQHAAPPKKKRKV

SEQ ID NO: 1100 - protein, 28 aa, synthetic construct
GGSGGSGGSGGSGGSGGSGGSGGSLEGS

SEQ ID NO: 1101 - protein, 27 aa, synthetic construct
YPYDVPDYAYPYDVPDYAYPYDVPDYA

SEQ ID NO: 1102 - DNA, 19 bp, synthetic construct
  source 1..19: mol_type = other DNA
aatttctactatcgtagat

SEQ ID NO: 1103 - DNA, 36 bp, synthetic construct
  source 1..36: mol_type = other DNA
gtttaataagaatacataatttctactatcgtagat

SEQ ID NO: 1104 - DNA, 19 bp, synthetic construct
  source 1..19: mol_type = other DNA
aatttctactattgtagat

SEQ ID NO: 1105 - DNA, 19 bp, synthetic construct
  source 1..19: mol_type = other DNA
aatttctactgttgtagat

SEQ ID NO: 1106 - DNA, 20 bp, synthetic construct
  source 1..20: mol_type = other DNA
aatttctactatgtgtagat

SEQ ID NO: 1107 - DNA, 20 bp, synthetic construct
  source 1..20: mol_type = other DNA
ggcggggtccagttccggga

SEQ ID NO: 1108 - DNA, 20 bp, synthetic construct
  source 1..20: mol_type = other DNA
ctgatggtccatgtctgtta

SEQ ID NO: 1109 - DNA, 23 bp, synthetic construct
  source 1..23: mol_type = other DNA
ccagaatgcacaaagtactgcac

SEQ ID NO: 1110 - DNA, 21 bp, synthetic construct
  source 1..21: mol_type = other DNA
gccaaagcccgagagagtgcc

SEQ ID NO: 1111 - DNA, 20 bp, synthetic construct
  source 1..20: mol_type = other DNA
ggagacgttcatgactggca

SEQ ID NO: 1112 - DNA, 20 bp, synthetic construct
  source 1..20: mol_type = other DNA
cgcctgggtcttcatcagag

SEQ ID NO: 1113 - DNA, 52 bp, synthetic construct
  source 1..52: mol_type = other DNA
acactctttccctacacgacgctcttccgatctgttcccttagcactctgcc

SEQ ID NO: 1114 - DNA, 58 bp, synthetic construct
  source 1..58: mol_type = other DNA
gactggagttcagacgtgtgctcttccgatctctcatggcaaaagcagtaatcagaac

SEQ ID NO: 1115 - protein, 22 aa, synthetic construct
SISKTLRFRLKPVGKTLENLEK

SEQ ID NO: 1116 - protein, 26 aa, synthetic construct
KENGEKVQGINEILNLTQQQLRRNPY

SEQ ID NO: 1117 - protein, 19 aa, synthetic construct
PDAAKMIPKCSISKKEVKN

SEQ ID NO: 1118 - protein, 28 aa, synthetic construct
GKLLLFQIYNKDFSPESKGKKNLHTLYW

SEQ ID NO: 1119 - protein, 18 aa, synthetic construct
IIGIDRGERHLLYYSVID

SEQ ID NO: 1120 - protein, 24 aa, synthetic construct
KIKELKDGYLSHVVHKLSKLIIDY

SEQ ID NO: 1121 - protein, 22 aa, synthetic construct
QLAKTLRFELIPLGRSLEFIKA

SEQ ID NO: 1122 - protein, 23 aa, synthetic construct
KSEGKEKTKGLNEYINLYNQKQK

SEQ ID NO: 1123 - protein, 19 aa, synthetic construct
PGANKMLPKVFFSKSRIDE

SEQ ID NO: 1124 - protein, 27 aa, synthetic construct
KIYLFKIYNKDFSPYSKGTPNLHTLYW

SEQ ID NO: 1125 - protein, 18 aa, synthetic construct
VIGIDRGERHLLYLTVID

SEQ ID NO: 1126 - protein, 21 aa, synthetic construct
NIKELKEGYLSQVIHKISELI

SEQ ID NO: 1127 - protein, 22 aa, synthetic construct
PLSKTLRFELIPVGKTLNSIIK

SEQ ID NO: 1128 - protein, 23 aa, synthetic construct
ESNIKIKGLNEYINLYNQQQKNK

SEQ ID NO: 1129 - protein, 19 aa, synthetic construct
KDLTTMVPKCTTQLNEVKT

SEQ ID NO: 1130 - protein, 28 aa, synthetic construct
EKIYLFQIYNKDFSPYSKGTPNLHTLYW

SEQ ID NO: 1131 - protein, 18 aa, synthetic construct
IIGIDRGERHLLYLSVID

SEQ ID NO: 1132 - protein, 24 aa, synthetic construct
NIKELKEGYLSQVIHKISELMIKY

SEQ ID NO: 1133 - protein, 22 aa, synthetic construct
QKTLRFELIPVGETQEHIEKKG

SEQ ID NO: 1134 - protein, 25 aa, synthetic construct
ESDRVKVQGINETINLYNQQVNSKD

SEQ ID NO: 1135 - protein, 21 aa, synthetic construct
KQVKPLTDFAHVFFAKKNIKK

SEQ ID NO: 1136 - protein, 28 aa, synthetic construct
GKIYLFQIYNKDFSVYSKGNPNLHTLYW

SEQ ID NO: 1137 - protein, 17 aa, synthetic construct
VIGIDRGERNLLYLVVI

SEQ ID NO: 1138 - protein, 24 aa, synthetic construct
TIKELKEGYLSQVIHVITEWMVKY

SEQ ID NO: 1139 - protein, 22 aa, synthetic construct
SLSKTLRFELKKPIGKTQEFIE

SEQ ID NO: 1140 - protein, 27 aa, synthetic construct
KKDIQKEGLNNLINKLSQKKDKDQEER

SEQ ID NO: 1141 - protein, 21 aa, synthetic construct
QKPHCESKFKLNFGDGYLLNG

SEQ ID NO: 1142 - protein, 34 aa, synthetic construct
GKLYLFTIYNKDFSEKKFKKDFSKRKPNLHTMYW

SEQ ID NO: 1143 - protein, 18 aa, synthetic construct
ILGLDRGERNLLYYYLLN

SEQ ID NO: 1144 - protein, 24 aa, synthetic construct
NIKDLKEGYLSRIIHEISKIVIDN

SEQ ID NO: 1145 - protein, 22 aa, synthetic construct
SEIQKTLRWRLIPIGKTKENMK

SEQ ID NO: 1146 - protein, 26 aa, synthetic construct
KKDNTKIQGINEIVNLQQQAINKGKK

SEQ ID NO: 1147 - protein, 20 aa, synthetic construct
PDAFRSIPKSSLAMRAVKEY

SEQ ID NO: 1148 - protein, 27 aa, synthetic construct
KLYLFQLYNKDFSEYSTGKPNLHTIYW

SEQ ID NO: 1149 - protein, 18 aa, synthetic construct
IIGIDRGERHLLYYSVIN

SEQ ID NO: 1150 - protein, 24 aa, synthetic construct
KIKDLKDGYLGQVVHFLAKLIIKY

SEQ ID NO: 1151 - protein, 19 aa, synthetic construct
QLQKTLRFELKPVPRDGET

SEQ ID NO: 1152 - protein, 25 aa, synthetic construct
QSGVEKGRGFNEKITQWNQAHKEKK

SEQ ID NO: 1153 - protein, 20 aa, synthetic construct
PSPVKMLPKIFFSRKGIETY

SEQ ID NO: 1154 - protein, 26 aa, synthetic construct
LFLFEIYNKDFSDNSGGRKNLHTLYW

SEQ ID NO: 1155 - protein, 18 aa, synthetic construct
IIGIDRGERNLISLVLID

SEQ ID NO: 1156 - protein, 24 aa, synthetic construct
KIAELKEGYVSQVVHAISKLIVEH

SEQ ID NO: 1157 - protein, 22 aa, synthetic construct
LTKTIGVELKPVGKTQELIEAK

SEQ ID NO: 1158 - protein, 15 aa, synthetic construct
AVNKAVNLYKQQHKT

SEQ ID NO: 1159 - protein, 18 aa, synthetic construct
YYHLKPNTLLGKSYIGNY

SEQ ID NO: 1160 - protein, 14 aa, synthetic construct
LRKSRGTENLHTMY

SEQ ID NO: 1161 - protein, 17 aa, synthetic construct
IGIDRGERNLLYLSLID

SEQ ID NO: 1162 - protein, 24 aa, synthetic construct
NIKDLKRGYLSQVVHIISKMMVEY

SEQ ID NO: 1163 - protein, 21 aa, synthetic construct
SISKTLRFELRPDEKTQENIK

SEQ ID NO: 1164 - protein, 24 aa, synthetic construct
EKNKKIKGLNEYINLYNQKQKESK

SEQ ID NO: 1165 - protein, 15 aa, synthetic construct
PGPNKMLPKVFLSTK

SEQ ID NO: 1166 - protein, 28 aa, synthetic construct
GKIYLFQIYNKDFSPHSKGTPNLHTLYW

SEQ ID NO: 1167 - protein, 18 aa, synthetic construct
IIGIDRGERHLLYISVVD

SEQ ID NO: 1168 - protein, 22 aa, synthetic construct
IKDLKEGYLSQAIHEISNLILK

SEQ ID NO: 1169 - protein, 22 aa, synthetic construct
QVSKTLRFELIPQGKTLENLTA

SEQ ID NO: 1170 - protein, 28 aa, synthetic construct
AGEAGRQKVQGLNETLNLAVQQDKKLEE

SEQ ID NO: 1171 - protein, 20 aa, synthetic construct
DFSKMLPKCTTQLKDVKQHF

SEQ ID NO: 1172 - protein, 28 aa, synthetic construct
GKLFLFQIYNKDFAEGATGAPNLHTIYW

SEQ ID NO: 1173 - protein, 18 aa, synthetic construct
VIGIDRGERNLIYAVVIN

SEQ ID NO: 1174 - protein, 24 aa, synthetic construct
KIKELKQGYLSLVIHEISKMMVQY

SEQ ID NO: 1175 - protein, 22 aa, synthetic construct
SISKTLRFELKPVGQTLESIKN

SEQ ID NO: 1176 - protein, 27 aa, synthetic construct
KEGGVNLRGINQFLNLYWQQHPDFAKE

SEQ ID NO: 1177 - protein, 24 aa, synthetic construct
DPSKDVPNLMVINGKTVKKNGRKD

SEQ ID NO: 1178 - protein, 28 aa, synthetic construct
GKLFLFQIYNKDFSEKSNGKKNLHTLYF

SEQ ID NO: 1179 - protein, 18 aa, synthetic construct
IIGLDRGERHLIYLSLIN

SEQ ID NO: 1180 - protein, 24 aa, synthetic construct
KIAELKEGYLSAVIHQLTKLMVEY

SEQ ID NO: 1181 - protein, 22 aa, synthetic construct
YPVSKTLRFELKPIGKTLEHIE

SEQ ID NO: 1182 - protein, 25 aa, synthetic construct
NDKEEKVQGINELINLYNQQNKTKI

SEQ ID NO: 1183 - protein, 20 aa, synthetic construct
PSPSKMLPKVFLSKKGINKY

SEQ ID NO: 1184 - protein, 28 aa, synthetic construct
GKLYLFQIHNKDFSPYAKGVPNLHTLYW

SEQ ID NO: 1185 - protein, 18 aa, synthetic construct
VIGIDRGERNLLYLVVVD

SEQ ID NO: 1186 - protein, 26 aa, synthetic construct
GNIKEIKEGYLSQVIHVIVELMIKYN

SEQ ID NO: 1187 - protein, 22 aa, synthetic construct
SLSKTLRFELKPIAETKENIEK

SEQ ID NO: 1188 - protein, 27 aa, synthetic construct
AEKEGEQNLRGINQFLNLYWQQNPEFA

SEQ ID NO: 1189 - protein, 18 aa, synthetic construct
DATKQIPKCSTQKKEVQK

SEQ ID NO: 1190 - protein, 28 aa, synthetic construct
GKLYLFQIYNKDFAPGANGRPNMHTLYW

SEQ ID NO: 1191 - protein, 18 aa, synthetic construct
IIGLDRGERHLIYLSLIN

SEQ ID NO: 1192 - protein, 24 aa, synthetic construct
KIAELKEGYLSAVIHQLTKLMVEY

SEQ ID NO: 1193 - protein, 19 aa, synthetic construct
SITVRNRLIPVGKTEENLK

SEQ ID NO: 1194 - protein, 22 aa, synthetic construct
EAGKEKIQGLNEKINLARQQLP

SEQ ID NO: 1195 - protein, 21 aa, synthetic construct
FFKDVTTMIPKCTTQLKDVKK

SEQ ID NO: 1196 - protein, 28 aa, synthetic construct
GKLYLFQIYNKDFAEKSSGKKNLHTLYW

SEQ ID NO: 1197 - protein, 18 aa, synthetic construct
IIGLDRGERHLIYLSLIN

SEQ ID NO: 1198 - protein, 26 aa, synthetic construct
NIKELKEGYLSNVVHEIAKLMVEHNA

SEQ ID NO: 1199 - protein, 22 aa, synthetic construct
SRSITLRNKLIPIGKTEENINQ

SEQ ID NO: 1200 - protein, 23 aa, synthetic construct
GEAGSEKVQGLNEKINLAKQQLP

SEQ ID NO: 1201 - protein, 20 aa, synthetic construct
FQKPDNKNTPRLFIRSKGES

SEQ ID NO: 1202 - protein, 28 aa, synthetic construct
GKLFLFQIYNKDFAEKSSGKKNLHTLYW

SEQ ID NO: 1203 - protein, 18 aa, synthetic construct
IIGLDRGERHLLYLSLIN

SEQ ID NO: 1204 - protein, 26 aa, synthetic construct
NIKELKEGYLSNIVHEIAKLMVENNA

SEQ ID NO: 1205 - protein, 22 aa, synthetic construct
EIQKTLRWRLIPIGKTKENMKK

SEQ ID NO: 1206 - protein, 26 aa, synthetic construct
KKDNTKIQGINEIVNLQQQAINKGKK

SEQ ID NO: 1207 - protein, 20 aa, synthetic construct
PDAFRSIPKSSLAMRAVKEY

SEQ ID NO: 1208 - protein, 28 aa, synthetic construct
GKLYLFQLYNKDFSEYSTGKPNLHTIYW

SEQ ID NO: 1209 - protein, 18 aa, synthetic construct
IIGIDRGERHLLYYSVIN

SEQ ID NO: 1210 - protein, 24 aa, synthetic construct
KIKDLKDGYLGQVVHFLAKLIIKY

SEQ ID NO: 1211 - protein, 22 aa, synthetic construct
SLSKTLRFELKPEPATKERFDK

SEQ ID NO: 1212 - protein, 28 aa, synthetic construct
KEIEDYNKIIGNYNLLINLYNQNRRNEK

SEQ ID NO: 1213 - protein, 24 aa, synthetic construct
KEKKKLIQKLVKELTYTKTEEERD

SEQ ID NO: 1214 - protein, 25 aa, synthetic construct
LFLFKIANKDLSYSETYSKGIRRKR

SEQ ID NO: 1215 - protein, 18 aa, synthetic construct
FIGIDRGEKHLVYSCIID

SEQ ID NO: 1216 - protein, 25 aa, synthetic construct
KNISNLKDGYISHVVHGLTNTIIKD

SEQ ID NO: 1217 - protein, 24 aa, synthetic construct
IENNKKIRGINEFTNLYRQQNPEF

SEQ ID NO: 1218 - protein, 20 aa, synthetic construct
PGPNKMLPKVFFSAKGKEIY

SEQ ID NO: 1219 - protein, 22 aa, synthetic construct
PVSKTLRFELKPIGQTLEKIKE

SEQ ID NO: 1220 - protein, 28 aa, synthetic construct
GKLFLFQIYNKDFAPGAKGKPNLHTLYW

SEQ ID NO: 1221 - protein, 19 aa, synthetic construct
IIGIDRGERNLIYMTLINQ

SEQ ID NO: 1222 - protein, 24 aa, synthetic construct
KIKELKEGYLSLVIHEIAKTMIEN

SEQ ID NO: 1223 - protein, 24 aa, synthetic construct
IENNTKIRGINEFANLYRQQNPEF

SEQ ID NO: 1224 - protein, 20 aa, synthetic construct
PSPHMSLPKAFFSKKGLALY

What is claimed is:

1. A composition comprising a nuclease, wherein the nuclease comprises an amino acid sequence with at least 90% identity to SEQ ID NO: 1017 and wherein the nuclease comprises an arginine at position 164 relative to the numbered positioned of SEQ ID NO: 1017.

2. The composition of claim 1, wherein the nuclease comprises SEQ ID NO: 1017.

3. The composition of claim 1, further comprising a fusion protein comprising the nuclease.

4. The composition of claim 3, wherein the fusion protein comprises a nuclear localization sequence.

5. The composition of claim 3, wherein the fusion protein comprises a purification tag sequence.

6. The composition of claim 1, further comprising at least one guide ribonucleic acid (gRNA).

7. The composition of claim 6, wherein the at least one gRNA comprises a first region configured to interact with the nuclease and a second region configured to hybridize with a portion of a target nucleic acid.

8. The composition of claim 7, wherein the nuclease, in a presence of the at least one gRNA, is capable of modifying the target nucleic acid.

9. The composition of claim 8, wherein the nuclease, in a presence of the at least one gRNA, is capable of modifying the target nucleic acid in a human cell.

10. The composition of claim 1, further comprising a nucleic acid comprising a nucleic acid sequence encoding at least one guide ribonucleic acid (gRNA).

11. The composition of claim 1, further comprising a cell comprising the nuclease.

12. The composition of claim 11, wherein the cell is a mammalian cell.

13. The composition of claim 12, wherein the mammalian cell is a human cell.

14. An engineered nuclease, wherein the engineered nuclease comprises an amino acid sequence with at least 90% identity to SEQ ID NO: 1017.

15. The engineered nuclease of claim 14, wherein the engineered nuclease comprises an amino acid sequence with at least 95% identity to SEQ ID NO: 1017.

16. The engineered nuclease of claim 14, wherein the engineered nuclease comprises a mutation at position 164.

* * * * *